US008716448B2

(12) United States Patent
Schellenberger et al.

(10) Patent No.: US 8,716,448 B2
(45) Date of Patent: May 6, 2014

(54) COAGULATION FACTOR VII COMPOSITIONS AND METHODS OF MAKING AND USING SAME

(75) Inventors: Volker Schellenberger, Palo Alto, CA (US); Joshua Silverman, Sunnyvale, CA (US); Willem Stemmer, Los Gatos, CA (US); Chia-wei Wang, Milpitas, CA (US); Benjamin Spink, San Carlos, CA (US); Nathan Geething, Santa Clara, CA (US); Wayne To, Fremont, CA (US)

(73) Assignee: Amunix Operating Inc., Mountain View, CA (US)

( * ) Notice: Subject to any disclaimer, the term of this patent is extended or adjusted under 35 U.S.C. 154(b) by 502 days.

(21) Appl. No.: 12/806,005

(22) Filed: Aug. 2, 2010

(65) Prior Publication Data
US 2011/0046061 A1   Feb. 24, 2011

Related U.S. Application Data

(63) Continuation-in-part of application No. 12/699,761, filed on Feb. 3, 2010.

(60) Provisional application No. 61/149,669, filed on Feb. 3, 2009, provisional application No. 61/185,112, filed on Jun. 8, 2009, provisional application No. 61/268,193, filed on Jun. 8, 2009, provisional application No. 61/236,493, filed on Aug. 24, 2009, provisional application No. 61/236,836, filed on Aug. 25, 2009, provisional application No. 61/243,707, filed on Sep. 18, 2009, provisional application No. 61/245,490, filed on Sep. 24, 2009, provisional application No. 61/280,955, filed on Nov. 10, 2009, provisional application No. 61/280,956, filed on Nov. 10, 2009, provisional application No. 61/281,109, filed on Nov. 12, 2009.

(30) Foreign Application Priority Data

Feb. 3, 2010 (WO) ................ PCT/US2010/023106

(51) Int. Cl.
A61K 38/36 (2006.01)
C07K 14/745 (2006.01)

(52) U.S. Cl.
USPC .......... 530/384; 530/402; 514/13.7; 514/14.3

(58) Field of Classification Search
None
See application file for complete search history.

(56) References Cited

U.S. PATENT DOCUMENTS

| 5,270,176 | A | 12/1993 | Dorschug et al. |
|---|---|---|---|
| 5,554,730 | A | 9/1996 | Woiszwillo et al. |
| 5,599,907 | A | 2/1997 | Anderson et al. |
| 5,837,679 | A | 11/1998 | Wolf et al. |
| 6,310,183 | B1 | 10/2001 | Johannessen et al. |
| 6,833,352 | B2 | 12/2004 | Johannessen et al. |
| 6,905,688 | B2 | 6/2005 | Rosen et al. |
| 7,276,475 | B2 | 10/2007 | Defrees et al. |
| 7,442,778 | B2 | 10/2008 | Gegg et al. |
| 7,452,967 | B2 | 11/2008 | Bertin |
| 7,511,024 | B2 | 3/2009 | Pederson et al. |
| 7,528,242 | B2 | 5/2009 | Anderson et al. |
| 7,632,921 | B2 | 12/2009 | Pan et al. |
| 7,645,860 | B2 | 1/2010 | Turecek et al. |
| 7,786,070 | B2 | 8/2010 | Johannessen et al. |
| 7,846,455 | B2 | 12/2010 | Collins et al. |
| 2003/0049689 | A1 | 3/2003 | Edwards et al. |
| 2003/0181381 | A1 | 9/2003 | Himmelspach et al. |
| 2003/0190740 | A1 | 10/2003 | Altman |
| 2004/0043446 | A1 | 3/2004 | DeFrees et al. |
| 2004/0259780 | A1 | 12/2004 | Glasebrook et al. |
| 2005/0042721 | A1 | 2/2005 | Fang et al. |
| 2005/0118136 | A1 | 6/2005 | Leung et al. |
| 2005/0123997 | A1 | 6/2005 | Lollar |
| 2005/0287153 | A1 | 12/2005 | Dennis |
| 2006/0026719 | A1 | 2/2006 | Kieliszewski et al. |
| 2006/0287220 | A1 | 12/2006 | Li et al. |
| 2006/0293232 | A1 | 12/2006 | Levy et al. |
| 2007/0048282 | A1 | 3/2007 | Rosen et al. |
| 2007/0161087 | A1 | 7/2007 | Glaesner et al. |
| 2007/0203058 | A1 | 8/2007 | Lau et al. |
| 2007/0244301 | A1 | 10/2007 | Siekmann et al. |
| 2008/0039341 | A1 | 2/2008 | Schellenberger et al. |
| 2008/0167238 | A1 | 7/2008 | Rosen et al. |
| 2008/0176288 | A1 | 7/2008 | Leung et al. |
| 2008/0193441 | A1 | 8/2008 | Trown et al. |
| 2008/0234193 | A1 | 9/2008 | Bossard et al. |

(Continued)

FOREIGN PATENT DOCUMENTS

CN   101190945     6/2008
EP   1203014 B1   10/2004

(Continued)

OTHER PUBLICATIONS

International search report and written opinion dated Dec. 20, 2010 for PCT Application No. US10/02147.
Schellenberger, et al. A recombinant polypeptide extends the in vivo half-life of peptides and proteins in a tunable manner. Nat Biotechnol. Dec. 2009;27(12):1186-92.
European search report and search opinion dated Jan. 27, 2011 for Application No. 08795371.7.
Buscaglia, et al. Tandem amino acid repeats from *Trypanosoma cruzi* shed antigens increase the half-life of proteins in blood. Blood. Mar. 15, 1999;93(6):2025-32.
International search report dated Jul. 12, 2011 for PCT Application No. US20/61590.

(Continued)

Primary Examiner — Marsha Tsay
(74) Attorney, Agent, or Firm — Wilson Sonsini Goodrich & Rosati

(57) ABSTRACT

The present invention relates to compositions comprising factor VII coagulation factors linked to extended recombinant polypeptide (XTEN), isolated nucleic acids encoding the compositions and vectors and host cells containing the same, and methods of making and using such compositions in treatment of coagulation factor-related diseases, disorders, and conditions.

42 Claims, 36 Drawing Sheets

(56) References Cited

U.S. PATENT DOCUMENTS

| | | | |
|---|---|---|---|
| 2008/0260755 A1 | 10/2008 | Metzner et al. | |
| 2008/0261877 A1 | 10/2008 | Ballance et al. | |
| 2008/0269125 A1 | 10/2008 | Ballance et al. | |
| 2008/0286808 A1 | 11/2008 | Schellenberger et al. | |
| 2008/0312157 A1 | 12/2008 | Levy et al. | |
| 2009/0042787 A1 | 2/2009 | Metzner et al. | |
| 2009/0060862 A1 | 3/2009 | Chang et al. | |
| 2009/0092582 A1 | 4/2009 | Bogin et al. | |
| 2009/0099031 A1* | 4/2009 | Stemmer et al. | 506/9 |
| 2010/0081187 A1 | 4/2010 | Griffith et al. | |
| 2010/0120664 A1 | 5/2010 | Schulte et al. | |
| 2010/0143326 A1 | 6/2010 | Rischel et al. | |
| 2010/0189682 A1 | 7/2010 | Schellenberger et al. | |
| 2010/0239554 A1 | 9/2010 | Schellenberger et al. | |
| 2010/0292130 A1 | 11/2010 | Skerra et al. | |
| 2011/0046060 A1 | 2/2011 | Schellenberger et al. | |
| 2011/0151433 A1 | 6/2011 | Schellenberger et al. | |

FOREIGN PATENT DOCUMENTS

| | | |
|---|---|---|
| WO | WO 97/33552 A1 | 9/1997 |
| WO | WO 9949901 A1 | 10/1999 |
| WO | WO 2005/025499 A2 | 3/2005 |
| WO | WO 2005/025499 A3 | 5/2005 |
| WO | WO 2006/081249 A2 | 8/2006 |
| WO | WO 2006/081249 A3 | 2/2007 |
| WO | WO 2007/090584 A1 | 8/2007 |
| WO | WO 2007/103455 A2 | 9/2007 |
| WO | WO 2007/103455 A3 | 11/2007 |
| WO | WO 2008/077616 A1 | 7/2008 |
| WO | WO 2008/155134 A1 | 12/2008 |
| WO | WO 2010/062768 A1 | 6/2010 |
| WO | WO 2010/091122 A1 | 8/2010 |
| WO | WO 2010/144502 A2 | 12/2010 |
| WO | WO 2010/144508 A1 | 12/2010 |
| WO | WO 2011/028228 A1 | 3/2011 |
| WO | WO 2011/028229 A1 | 3/2011 |
| WO | WO 2011/084808 A2 | 7/2011 |
| WO | WO 2011/123813 A2 | 10/2011 |
| WO | WO 2012/006624 A2 | 1/2012 |
| WO | WO 2012/006633 A1 | 1/2012 |

OTHER PUBLICATIONS

Uversky, et al. Why are "natively unfolded" proteins unstructured under,physiologic conditions? Proteins. Nov. 15, 2000;41(3):415-27.
Walker, et al. Using protein-based motifs to stabilize peptides. J Pept Res. Nov. 2003;62(5):214-26.
Wright, et al. Intrinsically unstructured proteins: re-assessing the protein structure-function paradigm. J Mol Biol. Oct. 22, 1999;293(2):321-31.
Altschul et al. Basic Local Alignment Search Tool. J. Mol. Biol. 1990; 215:403-410.
Alvarez, et al. Improving Protein Pharmacokinetics by Genetic Fusion to Simple Amino Acid Sequences. J Biol Chem. 2004; 279: 3375-81.
Arndt, et al. Factors influencing the dimer to monomer transition of an antibody single-chain Fv fragment. Biochemistry. 1998; 37(37):12918-26.
Ausubel, et al. eds. Current Protocols in Molecular Biology. Wiley. 1987.
Chou, et al. Prediction of Protein Conformation. Biochemistry. 1974; 13: 222-245.
Clark, et al. Long-acting growth hormones produced by conjugation with polyethylene glycol. J Biol Chem. 1996; 271(36):21969-77.
Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.
D'Aquino, et al. The magnitude of the backbone conformational entropy change in protein folding. Proteins. 1996; 25: 143-56.
Deckert, et al. Pharmacokinetics and microdistribution of polyethylene glycol-modified humanized A33 antibody targeting colon cancer xenografts. Int J Cancer. 2000; 87: 382-90.
Dhalluin, et al. Structural and biophysical characterization of the 40 kDa PEG-interferon-alpha2a and its individual positional isomers. Bioconjug Chem. 2005; 16: 504-17.
Ellis, et al. Valid and invalid implementations of GOR secondary structure predictions. Comput Appl Biosci. Jun. 1994;10(3):341-8. (Abstract only).
Greenwald, et al. Effective drug delivery by PEGylated drug conjugates. Adv Drug Deliv Rev. 2003; 55: 217-50.
Gustafsson, et al. Codon bias and heterologous protein expression. Trends Biotechnol. 2004; 22: 346-53.
Harris, et al. Effect of pegylation on pharmaceuticals. Nat Rev Drug Discov. 2003; 2: 214-21.
Hinds, et al. PEGylated insulin in PLGA microparticles. In vivo and in vitro analysis. J Control Release. Jun. 2, 2005;104(3):447-60.
Hopp, et al. Prediction of protein antigenic determinants from amino acid sequences. Proc Natl Acad Sci U S A 1981; 78, 3824, #3232.
International search report dated Oct. 29, 2010 for PCT Application No. US10/37855.
International search report dated Dec. 26, 2007 for PCT Application No. US2007/05952.
International search report dated Mar. 16, 2009 for PCT Application No. US2008/09787.
International search report dated Apr. 20, 2010 for PCT Application No. US10-23106.
Kochendoerfer. Chemical and biological properties of polymer-modified proteins. Expert Opin Biol Ther. 2003; 3: 1253-61.
Kohn, et al. Random-coil behavior and the dimensions of chemically unfolded proteins. Proc Natl Acad Sci U S A. Aug. 24, 2004;101(34):12491-6.
Kornblatt, et al. Cross-linking of cytochrome oxidase subunits with difluorodinitrobenzene. Can J. Biochem. 1980; 58: 219-224.
Kubetzko, et al. Protein PEGylation decreases observed target association rates via a dual blocking mechanism. Mol Pharmacol. 2005; 68: 1439-54.
Levitt. A simplified representation of protein conformations for rapid simulation of protein folding. J Mol Biol 1976; 104, 59-107.
McPherson, et al. eds. PCR 2: a practical approach. Oxford University Press. 1995.
Mitraki, et al. Protein Folding Intermediates and Inclusion Body Formation, 1989 Biotechnology 7: 690-697.
Oslo, ed. Remington's Pharmaceutical Sciences. 16th edition. 1980.
Pepinsky, et al. Improved pharmacokinetic properties of a polyethylene glycol-modified form of interferon-beta-1a with preserved in vitro bioactivity. J Pharmacol Exp Ther. 2001; 297: 1059-66.
Sambrook, et al. Molecular Cloning: A Laboratory Manual, 2nd Edition; Current Protocols in Molecular Biology. 1989.
Singh, et al. ProPred: Prediction of HLA-DR binding sites. Bioinformatics. 2001; 17: 1236-1237.
Smith, et al. Single-step purification of polypeptides expressed in Escherichia coli as fusions with glutathione S-transferase. Gene. 1988; 67(1):31-40.
Stickler, et al. Human population-based identification of CD4(+) T-cell peptide epitope determinants. J Immunol Methods. 2003; 281: 95-108.
Stites, et al. Empirical evaluation of the influence of side chains on the conformational entropy of the polypeptide backbone. Proteins. 1995; 22: 132-140.
Sturniolo, et al. Generation of tissue-specific and promiscuous HLA ligand databases using DNA microarrays and virtual HLA class II matrices. Natural Biotechnol. 1999; 17: 555-561.
Venkatachalam, et al. Conformation of polypeptide chains. Annu Rev Biochem. 1969; 38: 45-82.
Weimer, et al. Prolonged in-vivo half-life of factor VIIa by fusion to albumin. Thromb Haemost. Apr. 2008;99(4):659-67. (Abstract only).
Yang, et al. Tailoring structure-function and pharmacokinetic properties of single-chain Fv proteins by site-specific PEGylation. Protein Eng. 2003; 16: 761-70.
Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.

(56) References Cited

OTHER PUBLICATIONS

Bailon, et al. Rational design of a potent, long-lasting form of interferon: a 40 kDa branched polyethylene glycol-conjugated interferon alpha-2a for the treatment of hepatitis C. Bioconjug Chem. Mar.-Apr. 2001;12(2):195-202.

Cleland, et al. An extended half-life exenatide construct for weekly administration in the treatment of diabetes mellitus. In Diabetes, vol. 58, pp. A511-A512. 1701 N Beauregard St, Alexandria, VA 22311-1717 USA: Amer Diabetes Assoc, 2009. Abstract only.

Geething, et al. Gcg-XTEN: an improved glucagon capable of preventing hypoglycemia without increasing baseline blood glucose. PLoS One. Apr. 14, 2010;5(4):e10175. doi: 10.1371/journal.pone.0010175.

Kyngas, et al. Unreliability of the Chou-Fasman parameters in predicting protein secondary structure. Protein Eng. May 1998;11(5):345-8.

Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.

Schulte, et al. Prolonged In-Vivo Half-Life of FVIIa by fusion to Albumin. Blood (ASH Annual Meeting Abstracts). 2007, 110: Abstract 3142.

Schulte, S. Use of albumin fusion technology to prolong the half-life of recombinant factor VIIa. Thromb Res. 2008;122 Suppl 4:S14-9. doi: 10.1016/S0049-3848(08)70029-X.

\* cited by examiner

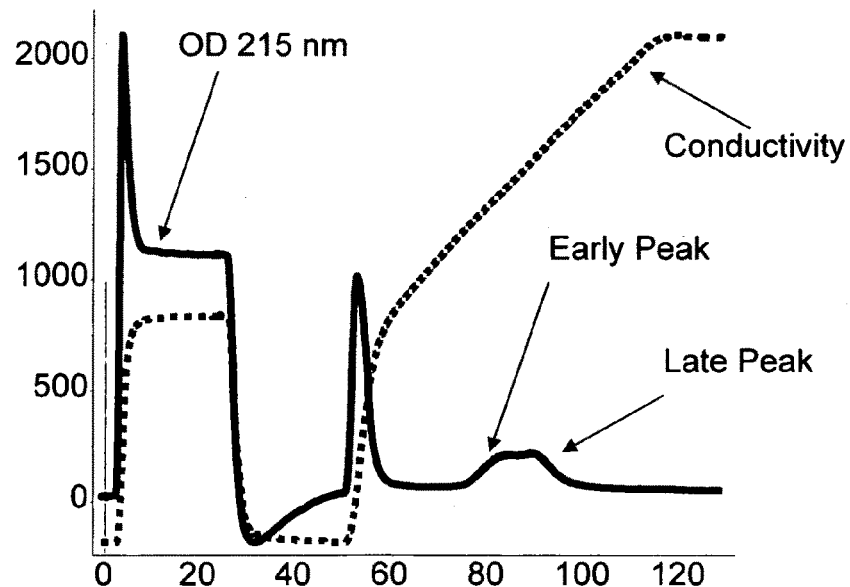
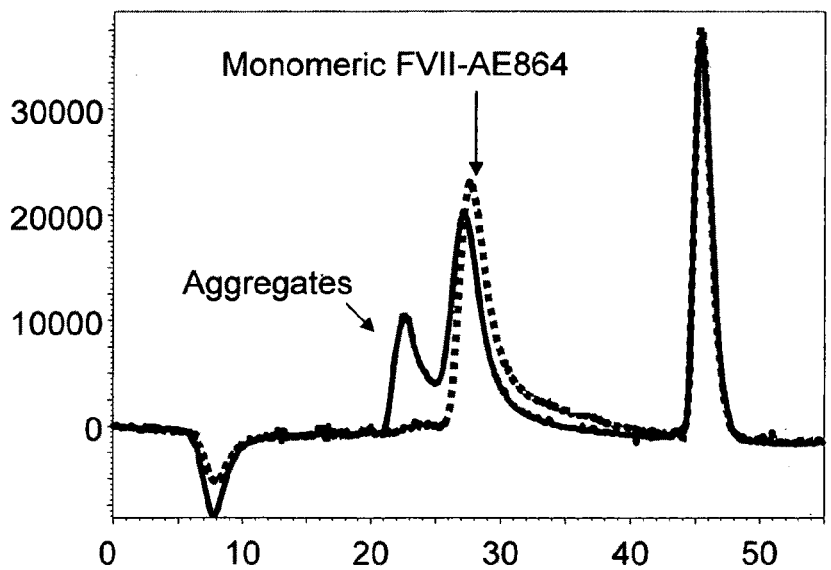
FIG. 21

```
LCW0569  ATGGCTNNNNNNGCTGGCTCTCCAACCTCCACTGAGGAAGGT
         M   A   X   X   A   G   S   P   T   S   T   E   E

LCW0570  ATGGCTNNNNNNGAAAGCGCAACCCCTGAGTCCGGTCCAGGT
         M   A   X   X   E   S   A   T   P   E   S   G   P

LCW0571  ATGGCTNNNNNNACTCCGTCTGGTGCTACCGGTTCCCCAGGT
         M   A   X   X   T   P   S   G   A   T   G   S   P
```

| X = APST, | GS | or | GE |
|---|---|---|---|
| TCAG/C/TCAG, | AG/G/TC | or | G/AG/AG |
| Diversity: 16 | 4 | | 4 |

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 27

1. Glucagon-Y288
2. Glucagon-Y144
3. Glucagon-Y72
4. Glucagon-Y36
---- = Standards

```
                    R145                                      R180
                     ↓                                         ↓
1  CEPAVPFPCGRVSVSQTSKLTRAETVFPDVDYVNSTEAETILDNITQSTQSFNDFTRVVGG
2  CTPTVEYPCGKIPILEKRNASK------------------------------PQGRIVGG
3  CTPTVEYPCGKIPILEKRNASK------------------------------DFTRIVGG
4  CTPTVEYPCGKIPILEKRKLTRAETVFPDVDYVNSTEAETILDNITQSTQSFNDFTRIVGG
5  CTPTVPFPCGRVSVSQTSKLTRAETVFPDVDYVNSTEAETILDNITQSTQSFNDFTRIVGG
6  CTPTVEYPCGKIPILEKRNASK------------------------------DFTRVVGG
7  CTPTVEYPCGKIPILEKRKLTRAETVFPDVDYVNSTEAETILDNITQSTQSFNDFTRVVGG
8  CTPTVPFPCGRVSVSQTSKLTRAETVFPDVDYVNSTEAETILDNITQSTQSFNDFTRVVGG
```

1. FIX, native
2. FVII, native
3. P4_R180-P2_R180
4. P4_R145-P2_R180
5. Entire AP
6. P4_R180-P1'_R180
7. P4_R145-P1'_R180
8. Entire AP + P1'

FIG. 36

COAGULATION FACTOR VII COMPOSITIONS AND METHODS OF MAKING AND USING SAME

CROSS-REFERENCE TO RELATED APPLICATIONS

This application is a continuation-in-part of U.S. application Ser. No. 12/699,761, filed Feb. 3, 2010, which in turn claims the priority benefit of U.S. Provisional Application Ser. Nos. 61/149,669, filed Feb. 3, 2009, 61/185,112 filed Jun. 8, 2009, 61/268,193, filed Jun. 8, 2009, 61/236,493 filed Aug. 24, 2009, 61/236,836, filed Aug. 25, 2009, 61/243,707, filed Sep. 18, 2009, 61/245,490, filed Sep. 24, 2009, 61/280,955, filed Nov. 10, 2009, 61/280,956 filed Nov. 10, 2009, and 61/281,109, filed Nov. 12, 2009. This application also claims the priority benefit of U.S. Provisional Application Nos. 61/236,493, filed Aug. 24, 2009, 61/236,836, filed Aug. 25, 2009, 61/280,955, filed Nov. 10, 2009, 61/280,956, filed Nov. 10, 2009 and PCT Application Serial No. PCT/US10/23106, filed Feb. 3, 2010, all of which are incorporated herein by reference in their entirety for all purposes.

STATEMENT REGARDING FEDERALLY SPONSORED RESEARCH

This invention was made with government support under SBIR grant 2R44GM079873-02 awarded by the National Institutes of Health. The government has certain rights in the invention.

SEQUENCE LISTING

The instant application contains a Sequence Listing which has been submitted in ASCII format via EFS-Web and is hereby incorporated by reference in its entirety. Said ASCII copy, created on Oct. 5, 2010, is named 32887192.txt and is 1,578,552 bytes in size.

BACKGROUND OF THE INVENTION

In hemophilia, the clotting of blood is disturbed by a lack of certain plasma blood clotting factors. Human factor IX (FIX) is a zymogen of a serine protease that is an important component of the intrinsic pathway of the blood coagulation cascade. In individuals who do not have FIX deficiency, the average half-life of FIX is short, approximately 18-24 hours. A deficiency of functional FIX, due to an X-linked disorder that occurs in about one in 30,000 males, results in hemophilia B, also known as Christmas disease, named after a young boy named Stephen Christmas who was found to be lacking this factor. Over 100 mutations of factor IX have been described; some cause no symptoms, but many lead to a significant bleeding disorder. When untreated, hemophilia B is associated with uncontrolled bleeding into muscles, joints, and body cavities following injury, and may result in death. Previously, treatments for the disease included administration of FIX prepared from human plasma derived from donor pools, which carried attendant risks of infection with blood-borne viruses including human immunodeficiency virus (HIV) and hepatitis C virus (HCV). More recently, recombinant FIX products have become commercially available.

The in vivo activity of exogenously supplied factor IX is limited both by protein half-life and inhibitors of coagulation, including antithrombin III. Factor IX compositions typically have short half-lives, requiring frequent injections. Also, current FIX-based therapeutics requires intravenous administration due to poor bioavailability. Thus, there is a need for improved factor IX compositions with extended half-life and retention of activity when administered as part of a preventive and/or therapeutic regimen for hemophilia, including hemophilia B.

Factor VII is a coagulation factor protein synthesized in the liver and secreted into the blood as a single chain zymogen with a molecular weight of approximately 50 kDa. The FVII zymogen is converted into an activated form (FVIIa) by proteolytic cleavage, and the activated form, when complexed with tissue factor (TF), is able to convert both factor IX and factor X into their activated forms, leading to rapid thrombin generation and fibrin formation. Because the circulating half-life of rFVIIa is about 2.3 hours ("Summary Basis for Approval for NovoSeven©", FDA reference number 96-0597), multiple and frequent administrations are required for the treatment of bleeding disorders in hemophiliacs and subjects with factor VII deficiency.

Chemical modifications to a therapeutic protein can reduce its in vivo clearance rate and subsequent increase serum half-life. One example of a common modification is the addition of a polyethylene glycol (PEG) moiety, typically coupled to the protein via an aldehyde or N-hydroxysuccinimide (NHS) group on the PEG reacting with an amine group (e.g. lysine side chain or the N-terminus). However, the conjugation step can result in the formation of heterogeneous product mixtures that need to be separated, leading to significant product loss and complexity of manufacturing and does not result in a completely chemically-uniform product. Also, the pharmacologic function of the therapeutics protein may be hampered if amino acid side chains in the vicinity of its binding site are modified by the PEGylation process. Fusing an Fc domain to the therapeutic protein is another approach to increases the size of the therapeutic protein, hence reducing the rate of clearance through the kidney. Additionally, the Fc domain confers the ability to bind to, and be recycled from lysosomes by, the FcRn receptor, which results in increased pharmacokinetic half-life. Unfortunately, the Fc domain does not fold efficiently during recombinant expression, and tends to form insoluble precipitates known as inclusion bodies. These inclusion bodies must be solubilized and functional protein must be renatured from the misfolded aggregate. Such process is time-consuming, inefficient, and expensive. Accordingly, there remains a need for improved coagulation factor compositions with increased half-life which can be administered less frequently, and/or be produced by a simpler process at a cheaper cost.

SUMMARY OF THE INVENTION

The present invention is directed to compositions and methods for the treatment or improvement of a condition or the enhancement of a parameter associated with the administration of coagulations factors IX and/or VII. In particular, the present invention provides compositions of fusion proteins comprising one or more extended recombinant polypeptides (XTEN). A subject XTEN is typically a non-repetitive sequence and unstructured conformation. XTEN is linked to a coagulation factor ("CF") selected from factor IX ("FIX"), factor VII ("FVII"), factor VII-factor IX hybrids, and sequence variants thereof, resulting in a coagulation factor-XTEN fusion protein ("CFXTEN"). In part, the present disclosure is directed to pharmaceutical compositions comprising the fusion proteins and the uses thereof for treating coagulation factor-related diseases, disorders or conditions. The CFXTEN compositions have enhanced pharmacokinetic properties compared to CF not linked to XTEN, which may permit more convenient dosing and improved efficacy. In some embodiments, the CFXTEN compositions of the invention do not have a component selected the group consisting of: polyethylene glycol (PEG), albumin, antibody, and an antibody fragment.

In some embodiments, the invention provides an isolated factor IX fusion protein, comprising a factor IX sequence that is at least about 90%, or about 95%, or about 96%, or about 97%, or about 98%, or about 99% identical to an amino acid sequence selected from Table 1. The factor IX having such sequence idendity is further linked to an extended recombinant polypeptide (XTEN) having at least about 100 to about 3000 amino acid residues. In one embodiment, the XTEN is linked to the C-terminus of the FIX or the FVII CF. In some embodiments, the invention provides an isolated factor VII fusion protein, comprising a factor VII that is at least about 90%, or about 95%, or about 96%, or about 97%, or about 98%, or about 99% identical to an amino acid sequence selected from Table 2. The factor VII having such sequence is linked to an extended recombinant polypeptide (XTEN).

Non-limiting examples of CFXTEN with a single FIX or a single FVII linked to a single XTEN are presented in Table 41. In one embodiment, the invention provides a CFXTEN composition has at least about 80% sequence identity compared to a CFXTEN from Table 41, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared to a CFXTEN from Table 41. In some embodiments, the CF and the XTEN components of the fusion protein are linked via a cleavage sequence that is cleavable by a protease, including endogenous mammalian proteases. Examples of such protease include, but are not limited to, FXIa, FXIIa, kallikrein, FVIIa, FIXa, FXa, thrombin, elastase-2, granzyme B, MMP-12, MMP-13, MMP-17 or MMP-20, TEV, enterokinase, rhinovirus 3C protease, and sortase A, or a sequence selected from Table 7. In one embodiment, a CFXTEN composition with a cleavage sequence has a sequence having at least about 80% sequence identity compared to a CFXTEN from Table 42, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared to a CFXTEN from Table 42. However, the invention also provides substitution of any of the CF sequences of Table 1 or Table 2 for a CF in a sequence of Table 42, and substitution of any XTEN sequence of Table 4 for an XTEN in a sequence of Table 42, and substitution of any cleavage sequence of Table 7 for a cleavage sequence in a sequence of Table 42. In CFXTEN embodiments having cleavage sequences, cleavage of the cleavage sequence by the protease releases the XTEN from the CF. In some embodiments of the foregoing, the CF component becomes biologically active or has an increase in activity upon its release from the XTEN by cleavage of the cleavage sequence, wherein the pro-coagulant activity is at least about 30%, or at least about 40%, or at least about 50%, or at least about 60%, or at least about 70%, or at least about 80%, or at least about 90% compared to the corresponding FIX or FVII not linked to XTEN.

The invention provides isolated CFXTEN fusion proteins that comprise a second XTEN of about 36 to about 3000 amino acid residues, which can be identical or can be different from the first XTEN, wherein the second XTEN can be incorporated between any two adjacent domains of the CF, i.e., between the Gla, EFG1, EGF2, activating peptide and protease domains, or is incorporated within the sequence of an existing loop domain of a domain sequence of the CF, as described more fully in the Examples. In one embodiment, the first and the second XTEN can be an amino acid sequence selected from any one of Tables 4, or 9-13, or can exhibit at least at least about 80%, or at least about 90%, or at least about 91%, or at least about 92%, or at least about 93%, or at least about 94%, or at least about 95%, or at least about 96%, or at least about 97%, or at least about 98%, or at least about 99% sequence identity compared to a sequence selected from Tables 4 and 9-13. In another embodiment, the isolated fusion protein comprises a second XTEN of about 36 to about 3000 amino acid residues. The fusion protein can adopt a multiple-XTEN configuration of Table 6, or a variation thereof.

The invention provides CFXTEN compositions comprising XTEN linked to a factor VII comprising one or more heterologous cleavage sequences cleavable by the same or different pro-coagulant proteases. In some embodiments of the foregoing, the factor VII comprises a heterologous sequence of factor XI incorporated into or substituted for portions of the FVII sequence, resulting in factor VII-factor IX hybrid sequence variants. In some embodiments, a portion or the entirety of the sequence from the activation peptide domain of FIX is incorporated or substituted for FVII sequences bridging the region between the EFG2 and protease domains of the FVII component, resulting in compositions that can be activated as part of the intrinsic system of the coagulation cascade (e.g., activated factor XI). In such case, the factor VII-factor IX CFXTEN composition can be activated by a pro-coagulant protease in the absence of tissue factor, such that the CFXTEN can serve as a by-pass of factors VIII and IX in the intrinsic coagulation pathway when such factors are deficient (e.g., in hemophilia A or B) or when inhibitors to these factors are present. In one embodiment, the FVII-FIX sequence variant incorporates the full-length FIX AP domain plus at least about 2, or at least about 3, or at least about 4, or at least about 5, or at least about 6, or at least about 7, or at least about 8, or at least about 9, or at least about 10, or at least about 11, or at least about 12 or more amino acids flanking adjacent amino acid residues on one or both sides of the R145-A146 and R180-V181 cleavage sites of the FIX AP domain (e.g., the sequence RVSVSQTSKLTRAETVFPD-VDYVNSTEAETILDNITQSTQSFNDFTRVVGGE (SEQ ID NO: 1) in the case of 12 flanking amino acids on the N-terminus side and 5 flanking amino acids on the C-terminus side).

In another embodiment, the CFXTEN FVII-FIX sequence variant comprises a heterologous FIX sequence exhibiting at least at least about 80%, or at least about 90%, or at least about 91%, or at least about 92%, or at least about 93%, or at least about 94%, or at least about 95%, or at least about 96%, or at least about 97%, or at least about 98%, or 100% identity compared to the sequence: KLTRAETVFPDVDYVNSTEA-ETILDNITQSTQSFNDFTRV (SEQ ID NO: 2), when optimally aligned.

In other embodiments, the CFXTEN comprises FVII-FIX sequence variants that incorporate a portion of the FIX AP that includes a sequence of at least about 2, or at least about 3, or at least about 4, or at least about 5, or more amino acids that flank one or both sides of the R145-A146 cleavage site (e.g., the sequence TSKLTRAETVFP (SEQ ID NO: 3) in the case of 6 flanking amino acids on either side of the cleavage site) or a sequence of at least about 2, or at least about 3, or at least about 4, or at least about 5 or more amino acids that flank one or both sides of the R180-V181 cleavage site (e.g., the sequence and DFTRV (SEQ ID NO: 4) in the case of 4 amino acids on the N-terminal flank and valine as the C-terminus of the cleavage site from FIX). In one embodiment of the foregoing, the CFXTEN FVII-FIX sequence variant comprises a heterologous FIX sequence exhibiting at least at least about 80%, or at least about 90%, or at least about 91%, or at least about 92%, or at least about 93%, or at least about 94%, or at least about 95%, or at least about 96%, or at least about 97%, or at least about 98%, or 100% identity compared to a sequence selected from TSKLTRAETVFP (SEQ ID NO: 3) and FNDFTRV (SEQ ID NO: 5), when optimally aligned.

In another embodiment, the CFXTEN comprises a FVII-FIX sequence variant disclosed above that further includes the same AP cleavage sequence as a linker between the C-terminus of the FVII component and the XTEN component of the fusion protein, e.g., an N- to C-terminus configuration of FVII variant-AP sequence-XTEN, thereby permitting the release of the FVII variant component from the CFXTEN fusion protein when cleaved by the same pro-coagulant protease as per that of the FVII to FVIIa transition. In one embodiment, the FVII-FIX CFXTEN of any of the foregoing embodiments includes the factor XI cleavage sequence KLTRAET (SEQ ID NO: 6) as the linker between the FVII-FIX sequence and the XTEN, thereby permitting the release of the FVII variant component from the CFXTEN fusion protein by the initiation of the intrinsic coagulation cascade. In one embodiment, the invention provides a CFXTEN with a FVII-FIX hybrid sequence that exhibits at least about 80%, or at least about 85%, or at least about 90%, or at least about 95%, or at least about 96%, or at least about 97%, or at least about 98%, or at least about 99%, sequence identity compared to a sequence from Table 43. In other embodiments, the invention provides a FVII-FIX sequence variant with incorporated FIX-derived AP cleavage sequence that is not linked to an XTEN. In one embodiment, the FVII-FIX sequence without an XTEN exhibits at least about 80%, or at least about 85%, or at least about 90%, or at least about 95%, or at least about 96%, or at least about 97%, or at least about 98%, or at least about 99% sequence identity as compared with a sequence from Table 43 without an XTEN.

In one embodiment of the CFXTEN composition, the invention provides a fusion protein of formula I:

$$(XTEN)_x\text{-CF-}(XTEN)_y \qquad\qquad I$$

wherein independently for each occurrence, CF is a coagulation factor; x is either 0 or 1 and y is either 0 or 1 wherein x+y≥1; and XTEN is an extended recombinant polypeptide.

In another embodiment of the CFXTEN composition, the invention provides a fusion protein of formula II:

$$(XTEN)_x\text{-}(CF)\text{-}(S)_y\text{-}(XTEN)_y \qquad\qquad II$$

wherein independently for each occurrence, CF is a coagulation factor a; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment of the CFXTEN composition, the invention provides an isolated fusion protein, wherein the fusion protein is of formula III:

$$(XTEN)_x\text{-}(S)_x\text{-}(CF)\text{-}(S)_y\text{-}(XTEN)_y \qquad\qquad III$$

wherein independently for each occurrence, CF is a coagulation factor; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment of the CFXTEN composition, the invention provides an isolated fusion protein of formula IV:

$$(Gla)\text{-}(XTEN)_u\text{-}(EGF1)\text{-}(XTEN)_v\text{-}(EGF2)\text{-}(XTEN)_w\text{-}(AP)\text{-}(XTEN)_x\text{-}(Pro)\text{-}(S)_y\text{-}(XTEN)_z \qquad\qquad IV$$

wherein independently for each occurrence, Gla is a Gla domain of FIX; EGF1 is an EGF1 domain of FIX; EGF2 is an EFG2 domain of FIX; AP is an activator peptide of FIX; PRO is a protease domain of FIX; S is a spacer sequence having between 1 to about 50 amino acid residues that can optionally include a cleavage sequence; u is either 0 or 1; v is either 0 or 1; x is either 0 or 1; y is either 0 or 1; z is either 0 or 1 with the proviso that u+v+w+x+z≥1; and XTEN is an extended recombinant polypeptide.

In another embodiment of the CFXTEN composition, the invention provides an isolated fusion protein of formula V:

$$(Gla)\text{-}(XTEN)_u\text{-}(EGF1)\text{-}(XTEN)\text{-}(EGF2)\text{-}(AP1)\text{-}(XTEN)_w\text{-}(AP2)\text{-}(XTEN)_x\text{-}(Pro)\text{-}(S)_y\text{-}(XTEN)_z \qquad\qquad V$$

wherein independently for each occurrence, Gla is a Gla domain of FIX; EGF1 is an EGF1 domain of FIX; EGF2 is an EFG2 domain of FIX; AP1 is the N-terminal sequence portion of the activator peptide domain of FIX that includes a first native cleavage sequence of the AP domain; AP2 is the C-terminal sequence portion of the activator peptide domain of FIX that includes a second native cleavage sequence of the AP domain; PRO is a protease domain of FIX; S is a spacer sequence having between 1 to about 50 amino acid residues that can optionally include a cleavage sequence; u is either 0 or 1; v is either 0 or 1; x is either 0 or 1; y is either 0 or 1; z is either 0 or 1 with the proviso that u+v+w+x+z≥1; then XTEN is an extended recombinant polypeptide.

In another embodiment of the CFXTEN composition, the invention provides an isolated fusion protein of formula VI:

$$(Gla)\text{-}(XTEN)_u\text{-}(EGF1)\text{-}(XTEN)_v\text{-}(EGF2)\text{-}(XTEN)_w\text{-}(Pro)\text{-}(S)_x\text{-}(XTEN)_y \qquad\qquad VI$$

wherein independently for each occurrence, Gla is a Gla domain of FVII; EGF1 is an EGF1 domain of FVII; EGF2 is an EFG2 domain of FVII; PRO is a protease domain of FVII; S is a spacer sequence having between 1 to about 50 amino acid residues that can optionally include a cleavage sequence; u is either 0 or 1; v is either 0 or 1; x is either 0 or 1; y is either 0 or 1 with the proviso that u+v'w+y≥1; and XTEN is an extended recombinant polypeptide.

In another embodiment of the CFXTEN composition, the invention provides an isolated fusion protein of formula VII:

$$(Gla)\text{-}(XTEN)_t\text{-}(EGF1)\text{-}(XTEN)_u\text{-}(EGF2)\text{-}(AP1)_v\text{-}(XTEN)_w\text{-}(AP2)\text{-}(XTEN)_x\text{-}(Pro)\text{-}(S)_y\text{-}(XTEN)_z \qquad\qquad VII$$

wherein independently for each occurrence, Gla is a Gla domain of FVII; EGF1 is an EGF1 domain of FVII; EGF2 is an EFG2 domain of FVII; PRO is a protease domain of FVII; AP1 is the N-terminal sequence portion of the activator peptide domain of FIX that includes the native cleavage sequence; AP2 is the C-terminal sequence portion of the activator peptide domain of FIX that includes the native cleavage sequence; S is a spacer sequence having between 1 to about 50 amino acid residues that can optionally include a cleavage sequence; t is either 0 or 1; u is either 0 or 1; v is either 0 or 1; x is either 0 or 1; y is either 0 or 1; z is either 0 or 1 with the proviso that t+u+w+z≥1; and XTEN is recombinant polypeptide. In the embodiment, the CFXTEN composition can include the entirety of the FIX activator peptide domain sequence or one or both cleavage sequences from the activator peptide domain of factor IX, e.g., a sequence of at least about 3 to about 12 amino acids that flank the R145-A146 cleavage site and the sequence of at least about 1 to about 5 amino acids that flank the R180-V181 cleavage site, as described more fully above. The invention also contemplates substitution of any of the other cleavage sequences of Table 7 for the AP cleavage sequences.

The CFXTEN compositions of the embodiments described herein can be evaluated for retention of activity (including after cleavage of any incorporated XTEN-releasing cleavage sites) using any appropriate in vitro assay disclosed herein (e.g., the assays of Table 40 or the assays described in the Examples), to determine the suitability of the configuration for use as a therapeutic agent in the treatment of a coagulation-factor related disease, disorder or condition. In one embodiment, the CFXTEN exhibits at least about 60%, or at least about 70%, or at least about 80%, or at least about 90% of the activity compared to the native CF not linked to XTEN. In another embodiment, the CF component released from the CFXTEN by enzymatic cleavage of the incorporated cleavage sequence linking the CF and XTEN components exhibits at least about 60%, or at least about 70%, or at least about 80%, or at least about 90% of the activity compared to the native CF not linked to XTEN.

The XTEN of the CFXTEN compositions have at least about 200, or at least about 400, or at least about 800, or at least about 900, or at least about 1000, or at least about 2000, up to about 3000 amino acids residues. The XTEN of the CFXTEN fusion protein compositions is characterized in that they have one or more of the following characteristics: (a) at least a first XTEN comprises at least about 200 contiguous amino acids that exhibits at least about 90%, or about 95%, or about 96%, or about 97%, or about 98%, or about 99% identity to a comparable length of an amino acid sequence selected from a sequence shown in Table 4; (b) the XTEN sequence lacks a predicted T-cell epitope when analyzed by TEPITOPE algorithm, wherein the TEPITOPE algorithm prediction for epitopes within the XTEN sequence is based on a score of −5, or −6, or −7, or −8, or −9 or greater; (c) the XTEN has a subsequence score of less than 10, or less than 9, or less than 8, or less than 7, or less than 6, or less than 5, or even less; (d) the sum of asparagine and glutamine residues is less than 10% of the total amino acid sequence of the XTEN; (e) the sum of methionine and tryptophan residues is less than 2% of the total amino acid sequence of the XTEN; (f) the XTEN has greater than 90% random coil formation, or about 95%, or about 96%, or about 97%, or about 98%, or about 99% random coil formation as determined by GOR algorithm; (g) the XTEN sequence has less than 2% alpha helices and 2% beta-sheets as determined by the Chou-Fasman algorithm; and (h) the sum of glycine (G), alanine (A), serine (S), threonine (T), glutamate (E) and proline (P) residues constitutes more than about 90%, or about 95%, or about 96%, or about 97%, or about 98%, or about 99% of the total amino acid residues of the XTEN.

In another embodiment, the invention provides CFXTEN fusion proteins, wherein the XTEN is characterized in that the sum of asparagine and glutamine residues is less than 10% of the total amino acid sequence of the XTEN, the sum of methionine and tryptophan residues is less than 2% of the total amino acid sequence of the XTEN, the XTEN sequence has less than 5% amino acid residues with a positive charge, the XTEN sequence has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm. In some embodiments, no one type of amino acid constitutes more than 30% of the XTEN sequence of the CFXTEN.

In another embodiment, the invention provides CFXTEN fusion proteins, wherein the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 9 to about 14 amino acid residues and wherein the sequence of any two contiguous amino acid residues does not occur more than twice in each of the sequence motifs consist of four to six types of amino acids selected from glycine (G), alanine (A), serine (S), threonine (T), glutamate (E) and proline (P). In one embodiment, the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein the motifs are selected from Table 3.

In some embodiments, the XTEN has a sequence in which no three contiguous amino acids are identical unless the amino acid is serine, in which case no more than three contiguous amino acids are serine residues. In other embodiment, the XTEN component of the CFXTEN has a subsequence score of less than 10, or less than 9, or less than 8, or less than 7, or less than 6, or less than 5, or less. In the embodiments of this paragraph, the XTEN is characterized as "substantially non-repetitive."

In some embodiments, the invention provides CFXTEN comprising at least a second XTEN, wherein the XTEN sequence exhibits at least about 80%, or at least about 90%, or at least about 91%, or at least about 92%, or at least about 93%, or at least about 94%, or at least about 95%, or at least about 96%, or at least about 97%, or at least about 98%, or at least about 99% sequence identity compared to a sequence from Table 4, Table 9, Table 10, Table 11, Table 12, or Table 13.

In some embodiments, CFXTEN fusion proteins exhibits enhanced pharmacokinetic properties compared to CF not linked to XTEN, wherein the enhanced properties include but are not limited to longer terminal half-life, larger area under the curve, increased time in which the blood concentration remains within the therapeutic window, increased time between consecutive doses results in blood concentrations within the therapeutic window, and decreased dose in moles over time that can be administered compared to a CF not linked to XTEN, yet still result in a blood concentration within the therapeutic window for that composition. In some embodiments, the terminal half-life of the CFXTEN fusion protein administered to a subject is increased at least about three-fold, or at least about four-fold, or at least about five-fold, or at least about six-fold, or at least about eight-fold, or at least about ten-fold, or at least about 20-fold, or at least about 40-fold, or at least about 60-fold, or at least about 100-fold, or even higher as compared to CF not linked to XTEN and administered to a subject at a comparable dose. In other embodiments, the terminal half-life of the CFXTEN fusion protein administered to a subject is at least about 12 h, or at least about 24 h, or at least about 48 h, or at least about 72 h, or at least about 96 h, or at least about 120 h, or at least about 144 h, or at least about 21 days or greater. In other embodiments, the enhanced pharmacokinetic property is reflected by the fact that the blood concentrations that remain within the therapeutic window for the CFXTEN fusion protein for a given period are at least about two fold, or at least about three-fold, or at least about four-fold, or at least about five-fold, or at least about six-fold, or at least about eight-fold, or at least about ten-fold longer, or at least about 20-fold, or at least about 40-fold, or at least about 60-fold, or at least about 100-fold compared to CF not linked to XTEN and administered to a subject at a comparable dose. The increase in half-life and time spent within the therapeutic window permits less frequent dosing and decreased amounts of the fusion protein (in moles equivalent) that are administered to a subject, compared to the corresponding CF not linked to XTEN. In one embodiment, administration of a CFXTEN to a subject using a therapeutically-effective dose regimen results in a gain in time of at least two-fold, or at least three-fold, or at least four-fold, or at least five-fold, or at least six-fold, or at least eight-fold, or at least 10-fold, or at least about 20-fold, or at least about 40-fold, or at least about 60-fold, or at least about 100-fold or higher between at least two consecutive $C_{max}$ peaks and/or $C_{min}$ troughs for blood levels of the fusion protein compared to the corresponding CF not linked to the XTEN and administered using a comparable dose regimen to a subject.

In some embodiments, the XTEN enhances thermostability of CF when linked to the XTEN wherein the thermostability is ascertained by measuring the retention of biological activity after exposure to a temperature of about 37° C. for at least about 7 days of the biologically active protein in comparison to the biologically active protein not linked to the XTEN. In one embodiment of the foregoing, the retention of biological activity increases by at least about 50%, at least about 60%, at least about 70%, at least about 80%, at least about 90%, at least about 100%, or about 150%, at least about 200%, at least about 300%, or about 500% longer compared to the CF not linked to the XTEN.

In some embodiments, the isolated CFXTEN fusion protein is configures to have reduced binding affinity for a clearance receptor as compared to the corresponding CF not linked to the XTEN. In one embodiment, the CFXTEN fusion protein exhibits binding affinity for a clearance receptor of the CF in the range of about 0.01%-30%, or about 0.1% to about 20%, or about 1% to about 15%, or about 2% to about 10% of the binding affinity of the corresponding CF not linked to the XTEN. In another embodiment, a CFXTEN fusion protein with reduced affinity can have reduced active clearance and a corresponding increase in half-life of at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold longer compared to the corresponding CF that is not linked to the XTEN.

In some embodiments, the invention provides CFXTEN fusion proteins wherein the CFXTEN exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the CF not linked to XTEN.

In some embodiments, CFXTEN fusion proteins exhibit an increased apparent molecular weight as determined by size exclusion chromatography, compared to the actual molecular weight. In some embodiments the CF comprising a FIX and at least a first XTEN exhibits an apparent molecular weight of at least about 400 kD, or at least about 500 kD, or at least about 700 kD, or at least about 1000 kD, or at least about 1400 kD, or at least about 1600 kD, or at least about 1800 kD, or at least about 2000 kD, while the actual molecular weight of each FIX component of the fusion protein is about 50 kD and the molecular weight of the fusion protein ranges from about 70 to about 125 kDa. In other embodiments, the CF comprising a FVII and at least a first XTEN exhibits an apparent molecular weight of at least about 400 kD, or at least about 500 kD, or at least about 700 kD, or at least about 1000 kD, or at least about 1400 kD, or at least about 1600 kD, or at least about 1800 kD, or at least about 2000 kD, while the actual molecular weight of each FIX component of the fusion protein is about 50 kD and the molecular weight of the fusion protein ranges from about 70 to about 125 kDa. Accordingly, the CFXTEN fusion proteins can have an apparent molecular weight that is about 6-fold greater, or about 8-fold greater, or about 10-fold greater, or about 12-fold greater, or about 15-fold greater than the actual molecular weight of the fusion protein. In some cases, the isolated CFXTEN fusion protein of any of the embodiments disclosed herein exhibit an apparent molecular weight factor under physiologic conditions that is greater than about 4, or about 5, or about 6, or about 7, or about 8, or about 10, or greater than about 15.

In some embodiments, administration of a therapeutically effective dose of a fusion protein of one of formulae I-VII to a subject in need thereof can result in a gain in time of at least two-fold, or at least three-fold, or at least four-fold, or at least five-fold or more spent within a therapeutic window for the fusion protein compared to the corresponding CF not linked to the XTEN of and administered at a comparable dose to a subject. In other cases, administration of a therapeutically effective dose of a fusion protein of an embodiment of formulas I-VII to a subject in need thereof can result in a gain in time between consecutive doses necessary to maintain a therapeutically effective dose regimen of at least 48 h, or at least 72 h, or at least about 96 h, or at least about 120 h, or at least about 7 days, or at least about 14 days, or at least about 21 days between consecutive doses compared to a CF not linked to XTEN and administered at a comparable dose.

The fusion proteins of the disclosed compositions can be designed to have different configurations, N- to C-terminus, of a CF and XTEN and optional spacer sequences, including but not limited to XTEN-CF, CF-XTEN, XTEN-S-CF, CF-S-XTEN, XTEN-CF-XTEN, CF-CF-XTEN, XTEN-CF-CF, CF-S-CF-XTEN, XTEN-CF-S-CF, and multimers thereof. The choice of configuration can, as disclosed herein, confer particular pharmacokinetic, physico/chemical, or pharmacologic properties including, in the case of an incorporated cleavage sequence, the release of the CF with a concomitant increase in activity.

In some embodiments, the CFXTEN fusion protein is characterized in that: (i) it has a longer half-life when administered to a subject compared to the corresponding coagulation factor not linked to the XTEN administered to a subject under an otherwise equivalent dose; (ii) when a smaller molar amount of the fusion protein is administered to a subject in comparison to the corresponding coagulation factor that lacks the XTEN administered to a subject under an otherwise equivalent dose regimen, the fusion protein achieves a comparable area under the curve (AUC) as the corresponding coagulation factor not linked to the XTEN; (iii) when a smaller molar amount of the fusion protein is administered to a subject in comparison to the corresponding coagulation factor that lacks the XTEN administered to a subject under an otherwise equivalent dose regimen, the fusion protein achieves a comparable therapeutic effect as the corresponding coagulation factor not linked to the XTEN; (iv) when the fusion protein is administered to a subject less frequently in comparison to the corresponding coagulation factor not linked to the XTEN administered to a subject using an otherwise equivalent molar amount, the fusion protein achieves a comparable area under the curve (AUC) as the corresponding coagulation factor not linked to the XTEN; (v) when the fusion protein is administered to a subject less frequently in comparison to the corresponding coagulation factor not linked to the XTEN administered to a subject using an otherwise equivalent molar amount, the fusion protein achieves a comparable therapeutic effect as the corresponding coagulation factor not linked to the XTEN; (vi) when an accumulatively smaller molar amount of the fusion protein is administered to a subject in comparison to the corresponding coagulation factor not linked to the XTEN administered to a subject under an otherwise equivalent dose period, the fusion protein achieves comparable area under the curve (AUC) as the corresponding coagulation factor not linked to the XTEN; or (vii) when an accumulatively smaller molar amount of the fusion protein is administered to a subject in comparison to the corresponding coagulation factor not linked to the XTEN administered to a subject under an otherwise equivalent dose period, the fusion protein achieves comparable therapeutic effect as the corresponding coagulation factor not linked to the XTEN.

The invention provides a method of producing a fusion protein comprising a factor VII or factor IX or a factor VII-factor IX hybrid coagulation factor fused to one or more extended recombinant polypeptides (XTEN), comprising: (a) providing host cell comprising a recombinant polynucleotide molecule encoding the fusion protein (b) culturing the host cell under conditions permitting the expression of the fusion protein; and (c) recovering the fusion protein from the culture. In one embodiment of the method, the coagulation factor of the fusion protein has at least 90% sequence identity compared to a sequence selected from Table 1 or Table 2. In another embodiment of the method, the one or more XTEN of the expressed fusion protein has at least about 90%, or about 91%, or about 92%, or about 93%, or about 94%, or about 95%, or about 96%, or about 97%, or about 98%, or about 99% to about 100% sequence identity compared to a sequence selected from Table 4. In another embodiment of the method, the host cell is a eukaryotic cell. In another embodiment of the method, the host cell is CHO cell. In another embodiment of the method the isolated fusion protein is recovered from the host cell cytoplasm in substantially soluble form.

The invention provides isolated nucleic acids comprising a polynucleotide sequence selected from (a) a polynucleotide encoding the fusion protein of any of the foregoing embodiments, or (b) the complement of the polynucleotide of (a). In one embodiment, the invention provides an isolated nucleic acid comprising a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity compared to (a) a polynucleotide sequence of comparable length selected from Table 41 and Table 42; or (b) the complement of the polynucleotide of (a). The invention provides expression vectors comprising the nucleic acid of any of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be a CF native signal sequence. The invention provides a host cell that comprises an expression vector of any of the embodiments hereinabove described in this paragraph. In one embodiment, the host cell is a eukaryotic cell. In another embodiment, the host cell is a CHO cell. In another embodiment, the host cell is HEK cell.

In one embodiment, the invention provides pharmaceutical compositions comprising the fusion protein of any of the foregoing embodiments and a pharmaceutically acceptable carrier. In another embodiment, the invention provides kits, comprising packaging material and at least a first container comprising the pharmaceutical composition of the foregoing embodiment and a label identifying the pharmaceutical composition and storage and handling conditions, and a sheet of instructions for the reconstitution and/or administration of the pharmaceutical compositions to a subject.

The invention provides a method of treating a coagulopathy or a coagulation factor-related disease, disorder or condition in a subject, comprising administering to the subject a therapeutically effective amount of a CFXTEN fusion protein of any of the foregoing embodiments. In one embodiment of the method, the coagulation-factor related condition is selected from bleeding disorders (e.g., defective platelet function, thrombocytopenia or von Willebrand's disease), coagulopathies (any disorder of blood coagulation, including coagulation factor deficiencies), hemophilia B (aka Christmas disease), factor IX-related bleeding disorders, factor VII deficiency, hemophilia A, vascular injury, uncontrolled bleeding in subjects not suffering from hemophilia, bleeding from trauma or surgery, bleeding due to anticoagulant therapy, and bleeding due to liver disease. In one embodiment of the method of treatment, the coagulopathy is hemophilia A. In one embodiment of the method of treatment, the coagulopathy is hemophilia B. In another embodiment of the method of treatment, the coagulopathy is factor VII deficiency. In another embodiment of the method of treatment, the CFXTEN is administered to a subject to control a bleeding episode. In another embodiment of the method of treatment, a CFXTEN comprising a factor VII-factor IX sequence hybrid is administered to a subject to control a bleeding episode, wherein the CFXTEN is activated by a pro-coagulant protease of the intrinsic coagulation cascade (e.g., activated factor XI). In another embodiment, the present invention provides a method of treating a clotting factor deficiency in a subject, comprising: administering to said subject a composition comprising a therapeutically effective amount of the factor VII provided herein.

In some embodiments, the composition can be administered subcutaneously, intramuscularly, or intravenously. In one embodiment, the composition is administered at a therapeutically effective amount, wherein the administration results in a gain in time spent within a therapeutic window for the fusion protein compared to the corresponding CF of the fusion protein not linked to the XTEN and administered at a comparable dose to a subject. The gain in time spent within the therapeutic window can at least three-fold longer than the corresponding CF not linked to the XTEN, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer than the corresponding CF not linked to XTEN. In some embodiments of the method of treatment, (i) a smaller molar amount of (e.g. of about two-fold less, or about three-fold less, or about four-fold less, or about five-fold less, or about six-fold less, or about eight-fold less, or about 100 fold-less or greater) the fusion protein is administered in comparison to the corresponding coagulation factor not linked to the XTEN under an otherwise same dose regimen, and the fusion protein achieves a comparable area under the curve and/or a comparable therapeutic effect as the corresponding coagulation factor not linked to the XTEN; (ii) the fusion protein is administered less frequently (e.g., every two days, about every seven days, about every 14 days, about every 21 days, or about, monthly) in comparison to the corresponding coagulation factor not linked to the XTEN under an otherwise same dose amount, and the fusion protein achieves a comparable area under the curve and/or a comparable therapeutic effect as the corresponding coagulation factor not linked to the XTEN; or (iii) an accumulative smaller molar amount (e.g. about 5%, or about 10%, or about 20%, or about 40%, or about 50%, or about 60%, or about 70%, or about 80%, or about 90% less) of the fusion protein is administered in comparison to the corresponding coagulation factor not linked to the XTEN under the otherwise same dose regimen the fusion protein achieves a comparable area under the curve and/or a comparable therapeutic effect as the corresponding coagulation factor not linked to the XTEN. The accumulative smaller molar amount is measured for a period of at least about one week, or about 14 days, or about 21 days, or about one month. In some embodiments of the method of treatment, the therapeutic effect is a measured parameter selected from blood concentrations of coagulation factor, prothrombin (PT) assay, activated partial prothrombin (aPTT) assay, bleeding time assay, whole blood clotting time (WBCT), and thrombelastography.

In another embodiment, invention provides a method of treating a disease, disorder or condition, comprising administering the pharmaceutical composition described above to a subject using multiple consecutive doses of the pharmaceutical composition administered using a therapeutically effective dose regimen. In one embodiment of the foregoing, the therapeutically effective dose regimen can result in a gain in time of at least three-fold, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer time between at least two consecutive $C_{max}$ peaks and/or $C_{min}$ troughs for blood levels of the fusion protein compared to the corresponding CF of the fusion protein not linked to the fusion protein and administered at a comparable dose regimen to a subject. In another embodiment of the foregoing, the administration of the fusion protein results in improvement in at least one measured parameter of a coagulation factor-related disease using less frequent dosing or a lower total dosage in moles of the fusion protein of the pharmaceutical composition compared to the corresponding biologically active protein component(s) not linked to the fusion protein and administered to a subject d using a therapeutically effective regimen to a subject.

The invention further provides use of the compositions comprising the fusion protein of any of the foregoing embodiments in the preparation of a medicament for treating a disease, disorder or condition in a subject in need thereof. In one embodiment of the foregoing, the disease, disorder or condition is selected from group consisting of bleeding disorders, coagulopathies, hemophilia B (aka Christmas disease), factor IX-related bleeding disorders, factor VII deficiency, vascular injury, bleeding from trauma or surgery, bleeding due to anticoagulant therapy, and liver disease. Any of the disclosed embodiments can be practiced alone or in combination depending on the interested application.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 1A shows the domain architecture of native FIX, with the gamma-carboxyglutamate domain, the EGF1 and EGF2 domains, the activation peptide, and the protease domain, with a linked XTEN at the C-terminus Arrows indicate the cleavage sites for the activation peptide domain. FIG. 1B shows a FIX molecule with an XTEN polypeptide attached to the C-terminus via a cleavage sequence, and indicates a site for proteolytic cleavage to release the XTEN (arrows indicate the cleavage sites for the activation peptide domain and the release point for the XTEN).

FIG. 2A shows an FIX-XTEN with two proteolytic cleavage sites (arrows) within the activation peptide of FIX, and a C-terminus XTEN without a cleavage site linkage. FIG. 2B is similar to the configuration of FIG. 2A, but the C-terminus XTEN is linked via a cleavage sequence, with the arrow indicating the release point. FIG. 2C shows three configurations of FIX-XTEN, with the XTEN integrated between the various domains of FIX. FIG. 2D shows an FIX-XTEN with the XTEN portion inserted into the activation peptide between the native cleavage sites, which would release the XTEN upon the proteolytic activation of FIX. FIG. 2E illustrates FIX-XTEN that contain multiple XTEN sequences inserted between different domains with the addition of a releasable XTEN at the C-terminus. FIG. 2F illustrates FIX-XTEN where the XTEN has been inserted within loop domains of FIX.

FIG. 4A shows a FVII-XTEN that has not been activated. FIG. 4B shows a FVII-XTEN in which the peptide has been cleaved, resulting in an activated FVIIa-XTEN; FIG. 4C illustrates a FVII-XTEN composition with a cleavage sequence for releasable XTEN in which the FVII component has not been activated, containing a cleavage site for the activation protease (AP) and a second cleavage site for the release protease (RP). FIG. 4D shows a composition of activated FVIIa-XTEN containing a cleavage site for the release protease.

FIGS. 5A-D show exemplary sites for XTEN insertion between boundaries of the FVII domains with inactive FVII on the left and an activated form of FVII on the right (A: Insertion of XTEN between Gla and EGF1 domain, B: Insertion of XTEN between EGF1 and EGF2. C: Insertion of XTEN at C-terminus of activation peptide, D: Insertion of XTEN at N-terminus of activation peptide). FIG. 5E shows examples of FVII-XTEN in which the XTEN is located within external loops within individual domains fusion proteins, with inactive FVII on the left and FVIIa on the right. The activation peptide in FVII is shown as a thin line versus XTEN that is shown as a fat line.

FIG. 8 A: Normal clotting system with the intrinsic and extrinsic cascade components. FIG. 8B illustrates a variation in which an inactive/low active form of FVII-XTEN (FVII*) is intended to bypass the FIX and FVIII components of the intrinsic system when activated endogenously after administration.

FIG. 21 shows two chromatography outputs demonstrating removal of aggregated protein from monomeric FVII-AE864 with anion exchange chromatography (see Example 26 for experimental details). FIG. 21A is a chromatogram depicting the elution profile of FVII-XTEN from a macrocap Q column with two peaks eluting after the buffer related early peak. FIG. 21B shows SEC chromatograms of the early and late macrocap Q peaks demonstrating the absence of aggregates in the early peak.

FIG. 27 shows three randomized libraries used for the third and fourth codons in the N-terminal sequences of clones from LCW546, LCW547 and LCW552 (see Example 14 for experimental details). The libraries were designed with the third and fourth residues modified such that all combinations of allowable XTEN codons were present at these positions, as shown. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of the three libraries LCW0569 (SEQ ID NOS 773 and 774, respectively), LCW0570 (SEQ ID NOS 775 and 776, respectively), and LCW0571 (SEQ ID NOS 777 and 778, respectively).

FIG. 34A shows an expression vector encoding XTEN fused to the 3' end of the sequence encoding FVII. Note that no additional leader sequences are required in this vector. FIG. 34B depicts an expression vector encoding XTEN fused to the 5' end of the sequence encoding FVII with a CBD leader sequence and a TEV protease site. FIG. 34C depicts an expression vector as in FIG. 34B where the CBD and TEV processing sites have been replaced with an optimized N-terminal leader sequence (NTS). FIG. 34D depicts an expression vector encoding an NTS sequence, an XTEN, a sequence encoding VFII, and then a second sequence encoding an XTEN.

FIG. 36 shows sequence alignments between portions of native FIX, native FVII, and FVII-FIX sequence hybrids with different portions of the AP domain incorporated in the portion of the molecule spanning the EGF2 and Pro domains. The legend provides construct names. Gaps in an individual sequence (dashes) represents stretches of non-homology to FIX but are otherwise continuous, linked sequences. The underlined amino acids are FIX-derived sequence.

DETAILED DESCRIPTION OF THE INVENTION

Figure 1:
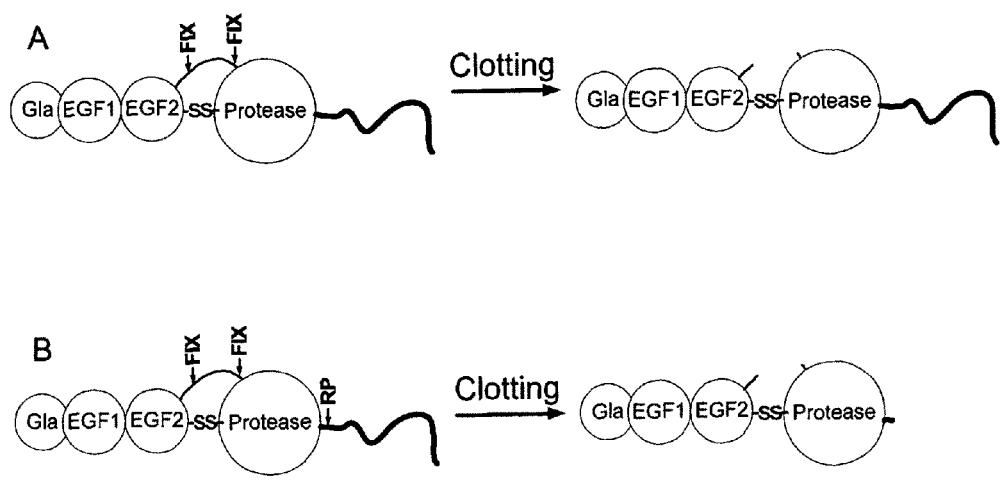
FIG. 1 shows a schematic representation of exemplary CFXTEN (FIX-XTEN) fusion proteins.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

DEFINITIONS

As used herein, the following terms have the meanings ascribed to them unless specified otherwise.

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity compared with the reference biologically active protein. As used herein, the term "biologically active protein moiety" includes proteins modified deliberately, as for example, by site directed mutagenesis, insertions, or accidentally through mutations.

As used herein, "internal XTEN" refers to XTEN sequences that have been inserted into the sequence of the coagulation factor. Internal XTENs can be constructed by insertion of an XTEN sequence into the sequence of a coagulation factor such as FIX or FVII, either by insertion between two adjacent amino acids or domains of the coagulation factor or wherein XTEN replaces a partial, internal sequence of the coagulation factor.

As used herein, "terminal XTEN" refers to XTEN sequences that have been fused to or in the N- or C-terminus of the coagulation factor or to a proteolytic cleavage sequence at the N- or C-terminus of the coagulation factor. Terminal XTENs can be fused to the native termini of the coagulation factor. Alternatively, terminal XTENs can replace a terminal sequence of the coagulation factor.

The term "XTEN release site" refers to a sequence in CFXTEN fusion proteins that can be recognized and cleaved by a mammalian protease, effecting release of an XTEN or a portion of an XTEN from the CFXTEN fusion protein. As used herein, "mammalian protease" means a protease that normally exists in the body fluids, cells or tissues of a mammal. XTEN release sites can be engineered to be cleaved by various mammalian proteases (a.k.a. "XTEN release proteases") such as FXIa, FXIIa, kallikrein, FVIIa, FIXa, FXa, FIIa (thrombin), Elastase-2, MMP-12, MMP13, MMP-17, MMP-20, or any protease that is present during a clotting event.

"Activity" as applied to form(s) of a CFXTEN polypeptide provided herein, refers to retention of a biological activity of the native coagulation factor, wherein "biological activity" refers to an in vitro or in vivo biological function or effect, including but not limited to either receptor or ligand binding, enzymatic activity, or an effect on coagulation generally known in the art for the coagulation factor.

A "therapeutic effect" as applied to form(s) of a CFXTEN polypeptide provided herein, refers to a physiologic effect, including but not limited to the curing, mitigation, reversal, amelioration or prevention of disease or conditions in humans or other animals, or to otherwise enhance physical or mental wellbeing of humans or animals. A "therapeutically effective amount" means an amount of compound effective to prevent, alleviate, reverse or ameliorate symptoms of disease or a condition (e.g., a bleeding episode) or prolong the survival of the subject being treated. Determination of a therapeutically effective amount is well within the capability of those skilled in the art, especially in light of the detailed disclosure provided herein.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two or more chemical elements or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" and "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity compared to those sequences.

"Ligation" refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al. (1989) Molecular Cloning: A Laboratory Manual, 2$^{nd}$ ed., vol. 1-3, Cold Spring Harbor Press, Plainview N.Y.; specifically see volume 2 and chapter 9. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Active clearance" means the mechanisms by which CF is removed from the circulation other than by filtration or coagulation, and which includes removal from the circulation mediated by cells, receptors, metabolism, or degradation of the CF.

"Apparent molecular weight factor" and "apparent molecular weight" are related terms referring to a measure of the relative increase or decrease in apparent molecular weight exhibited by a particular amino acid sequence. The apparent molecular weight is determined using size exclusion chromatography (SEC) and similar methods compared to globular protein standards and is measured in "apparent kD" units. The apparent molecular weight factor is the ratio between the apparent molecular weight and the actual molecular weight; the latter predicted by adding, based on amino acid composition, the calculated molecular weight of each type of amino acid in the composition or by estimation from comparison to molecular weight standards in an SDS electrophoresis gel.

The terms "hydrodynamic radius" or "Stokes radius" is the effective radius ($R_h$ in nm) of a molecule in a solution measured by assuming that it is a body moving through the solution and resisted by the solution's viscosity. In the embodiments of the invention, the hydrodynamic radius measurements of the XTEN fusion proteins correlate with the 'apparent molecular weight factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refers to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (1989). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Non-limiting examples for activation are the reaction of a carboxyl group with carbodiimide, the conversion of a carboxyl group into an activated ester, or the conversion of a carboxyl group into an azide function.

"Controlled release agent", "slow release agent", "depot formulation" and "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" and "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker that may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect", as used herein, refers to a physiologic effect, including but not limited to the cure, mitigation, amelioration, or prevention of disease in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose", as used herein, refer to an amount of a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial.

The term "therapeutically effective dose regimen", as used herein, refers to a schedule for consecutively administered multiple doses (i.e., at least two or more) of a biologically active protein, either alone or as a part of a fusion protein composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, N.J., 2000, the contents of which are incorporated in their entirety herein by reference.

II). Coagulation Factors

The present invention relates in part to fusion protein compositions comprising coagulation factors (CF). As used herein, "coagulation factor" or "CF" refers to factor IX (FIX), factor VII (FVII), sequence combinations of FVII and FIX, or mimetics, sequence variants and truncated versions thereof.

(a) Factor IX

"Factor IX" or "FIX" means a coagulation factor protein and species and sequence variants thereof, and includes, but is not limited to, the 461 single-chain amino acid sequence of human FIX precursor polypeptide ("prepro") and the 415 single-chain amino acid sequence of mature human FIX. FIX includes any form of factor IX molecule with the typical characteristics of blood coagulation factor IX. As used herein "factor IX" and "FIX" are intended to encompass polypeptides that comprise the domains Gla (region containing γ-carboxyglutamic acid residues), EGF1 and EGF2 (region containing sequences homologous to human epidermal growth factor), activation peptide (formed by residues R136-R180 of the mature FIX), and the C-terminal protease domain ("Pro"), or synonyms of these domains known in the art, or can be a truncated fragment or a sequence variant that retains at least a portion of the biological activity of the native protein. FIX or sequence variants have been cloned, as described in U.S. Pat. Nos. 4,770,999, 7,700,734, and cDNA coding for human factor IX has been isolated, characterized, and cloned into expression vectors (see, for example, Choo et al., Nature 299:178-180 (1982); Fair et al., Blood 64:194-204 (1984); and Kurachi et al., Proc. Natl. Acad. Sci., U.S.A. 79:6461-6464 (1982)).

Human factor IX (FIX) is encoded by a single-copy gene residing on the X-chromosome at q27.1. The human FIX mRNA is composed of 205 bases for the 5' untranslated region, 1383 bases for the prepro factor IX, a stop codon and 1392 bases for the 3' untranslated region. The FIX polypeptide is 55 kDa, synthesized as a preprocopolypeptide chain composed of three regions: a signal peptide of 28 amino acids, a propeptide of 18 amino acids, which is required for gamma-carboxylation of glutamic acid residues, and a mature factor IX of 415 amino acids. The propeptide is an 18-amino acid residue sequence N-terminal to the gamma-carboxyglutamate domain. The propeptide binds vitamin K-dependent gamma carboxylase and then is cleaved from the precursor polypeptide of FIX by an endogenous protease, most likely PACE (paired basic amino acid cleaving enzyme), also known as furin or PCSK3. Without the gamma carboxylation, the Gla domain is unable to bind calcium to assume the correct conformation necessary to anchor the protein to negatively charged phospholipid surfaces, thereby rendering factor IX nonfunctional. Even if it is carboxylated, the Gla domain also depends on cleavage of the propeptide for proper function, since retained propeptide interferes with conformational changes of the Gla domain necessary for optimal binding to calcium and phospholipid. In humans, the resulting mature factor IX is secreted by liver cells into the blood stream as an inactive zymogen, a single chain protein of 415 amino acid residues that contains approximately 17% carbohydrate by weight (Schmidt, A. E., et al. (2003) Trends Cardiovasc Med, 13: 39). The mature factor IX is composed of several domains that in an N- to C-terminus configuration are: a Gla domain, an EGF1 domain, an EGF2 domain, an activation peptide (AP) domain, and a protease (or catalytic) domain. FIX contains two activation peptides formed by R145-A146 and R180-V181, respectively. Following activation, the single-chain FIX becomes a 2-chain molecule, in which the two chains are linked by a disulfide bond attaching the enzyme to the Gla domain. CFs can be engineered by replacing their activation peptides resulting in altered activation specificity. In mammals, mature FIX must be activated by activated factor XI to yield factor IXa. The protease domain provides, upon activation of FIX to FIXa, the catalytic activity of FIX. Activated factor VIII (FVIIIa) is the specific cofactor for the full expression of FIXa activity.

Proteins involved in clotting include factor I, factor II, factor III, factor IV, factor V, factor VI, factor VII, factor VIII, factor IX, factor X, factor XI, factor XII, factor XIII, Protein C, and tissue factor ("clotting proteins"). The majority of the clotting proteins is present in zymogen form that when activated exhibits a pro-coagulant protease activity to activate other clotting proteins, contributing to the intrinsic or extrinsic coagulation pathway and clot formation. In the intrinsic pathway of the coagulation cascade, FIX associates with a complex of activated factor VIII, factor X, calcium, and phospholipid. In the complex, FIX is activated by factor XIa. The activation of factor IX is achieved by a two-step removal of the activation peptide (Ala 146-Arg 180) from the molecule (Bajaj et al., Human factor IX and factor IXa, in METHODS IN ENZYMOLOGY. 1993). The first cleavage is made at the Arg 145-Ala 146 site by either factor XIa or factor VIIa/tissue factor. The second and rate limiting cleavage is made at Arg 180-Val 181. The activation removes 35 residues. Activated human factor IX exists as a heterodimer of the C-terminal heavy chain (28 kDa) and an N-terminal light chain (18 kDa), which are held together by one disulfide bridge attaching the enzyme to the Gla domain. Factor IXa in turn activates factor X in concert with activated factor VIII. Alternatively, factors IX and X can both be activated by factor VIIa complexed with lipidated Tissue Factor, generated via the extrinsic pathway. Factor Xa then participates in the final common pathway whereby prothrombin is converted to thrombin, and thrombin in turn converts fibrinogen to fibrin to form the clot.

Defects in the coagulation process can lead to bleeding disorders in which the time taken for clot formation is prolonged. Such defects can be congenital or acquired. For example, hemophilia A and B are inherited diseases characterized by deficiencies in factor VIII (FVIII) and FIX, respectively. Replacement therapy with these proteins, generally prepared as recombinant proteins, may be used in the therapeutic intervention of hemophilia B (Christmas Disease) and factor IX-related bleeding disorders. Factor IX can be used in the treatment of both conditions. In some cases, however, patients develop antibodies against the administered proteins that reduce or negate the efficacy of the treatment.

The invention contemplates inclusion of FIX sequences in the CFXTEN compositions that have homology to FIX sequences, sequence fragments that are natural, such as from humans, non-human primates, mammals (including domestic animals), and non-natural sequence variants which retain at least a portion of the biologic activity or biological function of FIX and/or that are useful for preventing, treating, mediating, or ameliorating a coagulation factor-related disease, deficiency, disorder or condition (e.g., bleeding episodes related to trauma, surgery, of deficiency of a coagulation factor). Sequences with homology to human FIX can be found by standard homology searching techniques, such as NCBI BLAST.

In one embodiment, the FIX incorporated into the subject compositions is a recombinant polypeptide with a sequence corresponding to a protein found in nature. In another embodiment, the FIX is a sequence variant, fragment, homolog, or a mimetics of a natural sequence that retains at least a portion of the biological activity of the corresponding native FIX. Table 1 provides a non-limiting list of amino acid sequences of FIX that are encompassed by the CFXTEN fusion proteins of the invention. Any of the FIX sequences or homologous derivatives to be incorporated into the fusion protein compositions can be constructed by shuffling individual mutations between the amino acid sequences of Table 1 and evaluated for activity. Those that retain at least a portion of the biological activity of the native FIX are useful for the fusion protein compositions of this invention. FIX that can be incorporated into a CFXTEN fusion protein includes a protein that has at least about 80% sequence identity, or alternatively 81%, 82%, 83%, 84%, 85%, 86%, 87%, 88%, 89%, 90%, 91%, 92%, 93%, 95%, 96%, 97%, 98%, 99%, or 100% sequence identity compared to an amino acid sequence selected from Table 1.

TABLE 1

FIX amino acid and nucleic acid sequences

| Name | SEQ ID NO: | Amino Acid Sequence |
|---|---|---|
| FIX precursor polypeptide | 7 | MQRVNMIMAESPGLITICLLGYLLSAECTVFLDHENANKILNRPKRYNSGKLEEF VQGNLERECMEEKCSFEEAREVFENTERTTEFWKQYVDGDQCESNPCLNGGSCK DDINSYECWCPFGFEGKNCELDVTCNIKNGRCEQFCKNSADNKVVCSCTEGYRL AENQKSCEPAVPFPCGRVSVSQTSKLTRAETVFPDVDYVNSTEAETILDNITQSTQ SFNDFTRVVGGEDAKPGQFPWQVVLNGKVDAFCGGSIVNEKWIVTAAHCVETG VKITVVAGEHNIEETEHTEQKRNVIRIIPHHNYNAAINKYNHDIALLELDEPLVLNS YVTPICIADKEYTNIFLKFGSGYVSGWGRVFHKGRSALVLQYLRVPLVDRATCLR STKFTIYNNMFCAGFHEGGRDSCQGDSGGPHVTEVEGTSFLTGIISWGEECAMKG KYGIYTKVSRYVNWIKEKTKLT |
| FIX Homo sapiens | 8 | YNSGKLEEFVQGNLERECMEEKCSFEEAREVFENTERTTEFWKQYVDGDQCESN PCLNGGSCKDDINSYECWCPFGFEGKNCELDVTCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDEPLVLNSYVTPICIADKEYTNIFLKFGSGYVSGWGRVFHKGRSALVLQYLRVP LVDRATCLRSTKFTIYNNMFCAGFHEGGRDSCQGDSGGPHVTEVEGTSFLTGIIS WGEECAMKGKYGIYTKVSRYVNWIKEKTKLT |
| Sequence 4 from Patent US 20080214462 | 9 | MQRVNMIMAESPGLITICLLGYLLSAECTVFLDHENANKILNRPKRYNSGKLEEF VQGNLERECMEEKCSFEEAREVFENTERTTEFWKQYVDGDQCESNPCLNGGSCK DDINSYECWCPFGFEGKNCELDVTCNIKNGRCEQFCKNSADNKVVCSCTEGYRL AENQKSCEPAVPFPCGRVSVSQTSKLTRAEAVFPDVDYVNSTEAETILDNITQSTQ SFNDFTRVVGGEDAKPGQFPWQVVLNGKVDAFCGGSIVNEKWIVTAAHCVETG VKITVVAGEHNIEETEHTEQKRNVIRIIPHHNFNAAINTYNHDIALLELDEPLVNSY VTPICIADKEYTNIFLKFGSGYVSGWGRVFHKGRSALVLQYLRVPLVDRATCLRS TKFTIYNNMFCAGFHEGGRDSCQGDSGGPHVTEVEGTSFLTGIISWGEECAMKGK YGIYTKVSRYVNWIKEKTKLT |
| Sequence 6 from Patent US 20080214462 | 10 | MQRVNMIMAESPGLITICLLGYLLSAECTVFLDHENANKILNRPKRYNSGKLEEF VQGNLERECMEEKCSFEEAREVFENTERTTEFWKQYVDGDQCESNPCLNGGSCK DDINSYECWCPFGFEGKNCELDVTCNIKNGRCEQFCKNSADNKVVCSCTEGYRL AENQKSCEPAVPFPCGRVSVSQTSKLTRAEAVFPDVDYVNSTEAETILDNITQSTQ SFNDFTRVVGGEDAKPGQFPWQVVLNGKVDAFCGGSIVNEKWIVTAAHCVETG VKITVVAGEHNIEETEHTEQKRNVIRIIPHHNFNAAINTYNHDIALLELDEPLVNSY VTPICIADKEYTNIFLKFGSGYVSGWGRVFHKGRSALVLQYLRVPLVDRATCLRS TKFTIFNNMFCAGFHEGGRDSCQGDSGGPHVTEVEGTSFLTGIISWGEECAMKGK YGIYTKVSRYVNWIKEKTKLT |
| Sequence 8 from Patent US 20080214462 | 11 | MQRVNMIMAESPGLITICLLGYLLSAECTVFLDHENANKILNRPKRYNSGKLEEF VQGNLERECMEEKCSFEEAREVFENTERTTEFWKQYVDGDQCESNPCLNGGSCK DDINSYECWCPFGFEGKNCELDVTCNIKNGRCEQFCKNSADNKVVCSCTEG YRLAENQKSCEPAVPFPCGRVSVSQTSKLTRAEAVFPDVDYVNSTEAETILDNITQ STQSFNDFTRVVGGEDAKPGQFPWQVVLNGKVDAFCGGSIVNEKWIVTAAHCVE TGVKITVVAGEHNIEETEHTEQKRNVIRIIPHHNFNAAINTYNHDIALLELDEPLVL NSYVTPICIADKEYTNIFLKFGSGYVSGWGRVFHKGRSALVLQYLRVPLVDATCL RSTKFTIFNNMFCAGFHEGGRDSCQGDSGGPHVTEVEGTSFLTGIVSWGEGCAM KGKYGIYTKVSRYVNWIKEKTKLT |

TABLE 1-continued

FIX amino acid and nucleic acid sequences

| Name | SEQ ID NO: | Amino Acid Sequence |
|---|---|---|
| Sequence 2 from Patent U.S. Pat. No. 7,125,841 | 12 | MQRVNMIMAESPSLITICLLGYLLSAECTVFLDHENANKILNRPKRYNSGKLEEFV QGNLERECMEEKCSFEEPREVFENTEKITEFWKQYVDGDQCESNPCLNGGSCKD DINSYECWCPFGFEGKNCELDVTCNIKNGRCEQFCKNSADNKVVCSCTEGYRLA ENQKSCEPAVPFPCGRVSVSQTSKLTRAEAVFPDVDYVNPTEAETILDNITQGTQS FNDFTRVVGGEDAKPGQFPWQVVLNGKVDAFCGGSIVNEKWIVTAAHCVETGV KITVVAGEHNIEETEHTEQKRNVIRAIIPHHNYNAAINKYNHDIALLELDEPLVLNS YVTPICIADKEYTNIFLKFGSGYVSGWARVFHKGRSALVLQYLRVPLVDRATCLR STKFTIYNNMFCAGFHEGGRDSCQGDSGGPHVTEVEGTSFLTGIISWGEECAMKG KYGIYTKVSRYVNWIKEKTKLT |
| Sequence 1 from Patent US 20080167219 | 13 | YNSGKLEEFVQGNLERECMEEKCSFEEAREVFENTERTTEFWKQYVDGDQCESN PCLNGGSCKDDINSYECWCPFGFEGKNCELDATCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDEPLVLNSYVTPICIADKEYTNIFLKFGSGYVSGWGRVFHKGRSALVLQYLRVP LVDRATCLRSTKFTIYNNMFCAGFHEGGRDSCQGDSGGPHVTEVEGTSFLTGIIS WGEECAMKGKYGIYTKVSRYVNWIKEKTKLT |
| Sequence 2 from Patent US 20080167219 | 14 | YNSGKLEEFVQGNLERECMEEKCSFEEAREVFENTERTTEFWKQYVDGDQCESN PCLNGGSCKDDINSYECWCPFGFEGKNCELDVTCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDAPLVLNSYVTPICIADKEYTNIFLKFGSGYVSGWGRVFHKGRSALVLQYLRVP LVDRATCLRSTKFTIYNNMFCAGFHEGGRDSCQGDSGGPHVTEVEGTSFLTGIIS WGEECAMKGKYGIYTKVSRYVNWIKEKTKLT |
| Sequence 3 from Patent US 20080167219 | 15 | YNSGKLEEFVQGNLERECMEEKCSFEEAREVFENTERTTEFWKQYVDGDQCESN PCLNGGSCKDDINSYECWCPFGFEGKNCELDATCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDAPLVLNSYVTPICIADKEYTNIFLKFGSGYVSGWGRVFHKGRSALVLQYLRVP LVDRATCLRSTKFTIYNNMFCAGFHEGGRDSCQGDSGGPHVTEVEGTSFLTGIIS WGEECAMKGKYGIYTKVSRYVNWIKEKTKLT |
| Sequence 4 from Patent US 20080167219 | 16 | YNSGKLEEFVQGNLERECMEEKCSFEEAREVFENTERTTEFWKQYVDGDQCESN PCLNGGSCKDDINSYECWCPFGFEGKNCELDATCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDEPLVLNSYVTPICIADKEYTNIFLKFGSGYVSGWGRVFHKGRSALVLQYLRVP LVDRATCLASTKFTIYNNMFCAGFHEGGRDSCQGDSGGPHVTEVEGTSFLTGIIS WGEECAMKGKYGIYTKVSRYVNWIKEKTKLT |
| Sequence 5 from Patent US 20080167219 | 17 | YNSGKLEEFVQGNLERECMEEKCSFEEAREVFENTERTTEFWKQYVDGDQCESN PCLNGGSCKDDINSYECWCPFGFEGKNCELDVTCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDAPLVLNSYVTPICIADKEYTNIFLKFGSGYVSGWGRVFHKGRSALVLQYLRVP LVDRATCLASTKFTIYNNMFCAGFHEGGRDSCQGDSGGPHVTEVEGTSFLTGIIS WGEECAMKGKYGIYTKVSRYVNWIKEKTKLT |
| Sequence 6 from Patent US 20080167219 | 18 | YNSGKLEEFVQGNLERECMEEKCSFEEAREVFENTERTTEFWKQYVDGDQCESN PCLNGGSCKDDINSYECWCPFGFEGKNCELDATCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDAPLVLNSYVTPICIADKEYTNIFLKFGSGYVSGWGRVFHKGRSALVLQYLRVP LVDRATCLASTKFTIYNNMFCAGFHEGGRDSCQGDSGGPHVTEVEGTSFLTGIIS WGEECAMKGKYGIYTKVSRYVNWIKEKTKLT |
| Sequence 8 from Patent US 20080167219 | 19 | YNSGKLEEFVQGNLERECMEEKCSFEEAREVFENTERTTEFWKQYVDGDQCESN PCLNGGSCKDDINSYECWCPFGFEGKNCELDVTCNIKNGRCEQFCKNSADNKVV CSCTEGYRLAENQKSCEPAVPFPCGRVSVSQTSKLTRAETVFPDVDYVNSTEAETI LDNITQSTQSFNDFTRVVGGEDAKPGQFPWQVVLNGKVDAFCGGSIVNEKWIVT AAHCVETGVKITVVAGEHNIEETEHTEQKRNVIRIIPHHNYNAAINKYNHDIALLE LDEPLVLNSYVTPICIADKEYTNIFLKFGSGYVSGWGRVFHKGRSALVLQYLRVP LVDRATCLASTKFTIYNNMFCAGFHEGGRDSCQGDSGGPHVTEVEGTSFLTGIIS WGEECAMKGKYGIYTKVSRYVNWIKEKTKLT |

(b) Factor VII.

"Factor VII" or "FVII" means a coagulation factor protein and species and sequence variants thereof, and includes, but is not limited to, both the inactive and activated forms (unless indicated to the contrary) of the 406 single-chain amino acid sequence of human FVII, and the 444 amino acid sequence of the precursor protein. As used herein, factor VII and FVII encompass polypeptides that comprise the domains Gla (region containing Y-carboxyglutamic acid residues), EGF1 and EGF2 (region containing sequences homologous to human epidermal growth factor), an activation peptide domain that spans the sequence between the EGF2 and Pro domains, and a catalytic or peptidase 51 domain ("Pro" region containing the serine protease catalytic triad), or synonyms of these domains known in the art, or can be a truncated fragment or a sequence variant that retains at least a portion of the biological activity of the native protein. Factor VII (FVII), a vitamin K-dependent plasma protein produced by the liver, initially circulates in the blood as a zymogen. The main role of factor VII is to initiate the process of coagulation in conjunction with tissue factor (TF). Upon vessel injury, tissue factor is exposed to the blood and circulating factor VII. Once bound to TF, FVII is activated to become the activated form of factor VII (FVIIa) by different proteases, among which are thrombin (factor IIa), factor Xa, IXa, XIIa, and the FVIIa-TF complex itself. The FVII zymogen is activated by proteolytic cleavage at a single site, $Arg^{152}$-$Ile^{153}$, resulting in a two-chain protease linked by a single disulphide bond (FVIIa). FVIIa binds its cofactor, tissue factor (TF), to form a complex which can activate factor X (FX) to FXa, thereby initiating a coagulation cascade that results in fibrin formation and hemostasis. The complete nucleotide and amino acid sequences for human factor VII are known, and human FVII or sequence variants have been cloned, as described in U.S. Pat. Nos. 4,784,950, 5,833,982, 6911323, and 7,026,524.

Current therapeutic uses of factor VII exist but can be problematic in the treatment of individuals exhibiting a deficiency in factor VII, factor VIII, or factor IX, and individuals with Von Willebrand's disease with FVIIa formulations. More specifically, individuals receiving factors VIII and IX in replacement therapy frequently develop antibodies to these proteins. Continuing treatment is exceedingly difficult because of the presence of these antibodies. Patients experiencing this problem are normally treated with an activated prothrombin complex known to consist of a mixture of active and inactive clotting enzymes, including factor VIIa. FVII also is utilized in connection with treatment of uncontrolled bleedings, such as trauma, and it is believed that factor VIIa is capable of activating factor X to factor Xa without binding to tissue factor, and this activation reaction is believed to occur primarily on activated blood platelets (Hedner et al. Blood Coagulation & Fibrinolysis, 2000; 11; 107-111).

Sequence variants of factor VII, whether exhibiting substantially the same or better bioactivity than wild-type factor VII, or, alternatively, exhibiting substantially modified or reduced bioactivity relative to wild-type factor VII, include, polypeptides having an amino acid sequence that differs from the sequence of wild-type factor VII by insertion, deletion, or substitution of one or more amino acids. Such FVII variants are known in the art, including those described in United States Patent and Application Nos. U.S. Pat. Nos. 6,960,657, 7,176,288, 7414022, 7,700,733, 20060205036A1, 20080318276A1, and 20090011992A1, which are incorporated herein by reference.

Recombinant FVIIa has been approved for the treatment of hemophilia A or B patients that have inhibitors to FVIII or FIX, and also is used to stop bleeding episodes or prevent bleeding associated with trauma and/or surgery. Recombinant FVIIa also has been approved for the treatment of patients with congenital FVII deficiency, and is increasingly being utilized in off-label uses, such as the treatment of bleeding associated with other congenital or acquired bleeding disorders, trauma, and surgery in hemophilic and non-hemophilic patients.

The invention contemplates inclusion in the CFXTEN compositions sequences with homology to FVII sequences, sequence fragments, mimetics and non-natural sequence variants which retain at least a portion of the biologic activity or biological function of FVIIa that are useful for preventing, treating, mediating, or ameliorating a CF-related disease, deficiency, disorder or condition. In addition, because of the comparatively long-half life of CFXTEN comprising FVII, compositions comprising the inactive form of FVII that can be activated by mammalian endogenous proteases (described more fully below) or undergo autoactivation represents a means to treat subjects with certain forms of chronic coagulopathies with what is essentially a "prodrug" form of FVII. Table 2 provides a list of sequences of FVII that are encompassed by the CFXTEN fusion proteins of the invention. FVII sequences or homologous derivatives constructed by shuffling individual mutations between species or families that retain at least a portion of the biological activity of the native CF are useful for the fusion proteins of this invention. FVII that can be incorporated into a CFXTEN fusion protein include a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence selected from Table 2.

TABLE 2

Factor VII amino acid sequences

| Name | SEQ ID NO: | Amino Acid Sequence |
|---|---|---|
| FVII precursor polypeptide | 20 | MVSQALRLLCLLLGLQGCLAAVFVTQEEAHGVLHRRRRANAFLEELRPGSLERE CKEEQCSFEEAREIFKDAERTKLFWISYSDGDQCASSPCQNGGSCKDQLQSYICF CLPAFEGRNCETHKDDQLICVNENGGCEQYCSDHTGTKRSCRCHEGYSLLADG VSCTPTVEYPCGKIPILEKRNASKPQGRIVGGKVCPKGECPWQVLLLVNGAQLC GGTLINTIWVVSAAHCFDKIKNWRNLIAVLGEHDLSEHDGDEQSRRVAQVIIPST YVPGTTNHDIALLRLHQPVVLTDHVVPLCLPERTFSERTLAFVRFSLVSGWGQLL DRGATALELMVLNVPRLMTQDCLQQSRKVGDSPNITEYMFCAGYSDGSKDSCK GDSGGPHATHYRGTWYLTGIVSWGQGCATVGHFGVYTRVSQYIEWLQKLMRS EPRPGVLLRAPFP |
| Human FVII (mature) | 21 | ANAFLEELRPGSLERECKEEQCSFEEAREIFKDAERTKLFWISYSDGDQCASSPCQ NGGSCKDQLQSYICFCLPAFEGRNCETHKDDQLICVNENGGCEQYCSDHTGTKR |

TABLE 2-continued

Factor VII amino acid sequences

| Name | SEQ ID NO: | Amino Acid Sequence |
|---|---|---|
| | | SCRCHEGYSLLADGVSCTPTVEYPCGKIPILEKRNASKPQGRIVGGKVCPKGECP
WQVLLLVNGAQLCGGTLINTIWVVSAAHCFDKIKNWRNLIAVLGEHDLSEHDG
DEQSRRVAQVIIPSTYVPGTTNHDIALLRLHQPVVLTDHVVPLCLPERTFSERTLA
FVRFSLVSGWGQLLDRGATALELMVLNVPRLMTQDCLQQSRKVGDSPNITEYM
FCAGYSDGSKDSCKGDSGGPHATHYRGTWYLTGIVSWGQGCATVGHFGVYTR
VSQYIEWLQKLMRSEPRPGVLLRAPFP |
| FVII variant | 22 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKSLTRNGPLKVCPKGECPW
QVLLLVNGAQLCGGTLINTIWVVSAAHCFDKIKNWRNLIAVLGEHDLSEHDGDE
QSRRVAQVIIPSTYVPGTTNHDIALLRLHQPVVLTDHVVPLCLPERTFSERTLAFV
RFSLVSGWGQLLDRGATALELMVLNVPRLMTQDCLQQSRKVGDSPNITEYMFC
AGYSDGSKDSCKGDSGGPHATHYRGTWYLTGIVSWGQGCATVGHFGVYTRVS
QYIEWLQKLMRSEPRPGVLLRAPFP |
| FVII variant | 23 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKSMTRVVGGKVCPKGECP
WQVLLLVNGAQLCGGTLINTIWVVSAAHCFDKIKNWRNLIAVLGEHDLSEHDG
DEQSRRVAQVIIPSTYVPGTTNHDIALLRLHQPVVLTDHVVPLCLPERTFSERTLA
FVRFSLVSGWGQLLDRGATALELMVLNVPRLMTQDCLQQSRKVGDSPNITEYM
FCAGYSDGSKDSCKGDSGGPHATHYRGTWYLTGIVSWGQGCATVGHFGVYTR
VSQYIEWLQKLMRSEPRPGVLLRAPFP |
| FVII variant | 24 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKCGQRLRKSKVCPKGECP
WQVLLLVNGAQLCGGTLINTIWVVSAAHCFDKIKNWRNLIAVLGEHDLSEHDG
DEQSRRVAQVIIPSTYVPGTTNHDIALLRLHQPVVLTDHVVPLCLPERTFSERTLA
FVRFSLVSGWGQLLDRGATALELMVLNVPRLMTQDCLQQSRKVGDSPNITEYM
FCAGYSDGSKDSCKGDSGGPHATHYRGTWYLTGIVSWGQGCATVGHFGVYTR
VSQYIEWLQKLMRSEPRPGVLLRAPFP |
| FVII variant | 25 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKIKPRIVGGKVCPKGECPW
QVLLLVNGAQLCGGTLINTIWVVSAAHCFDKIKNWRNLIAVLGEHDLSEHDGDE
QSRRVAQVIIPSTYVPGTTNHDIALLRLHQPVVLTDHVVPLCLPERTFSERTLAFV
RFSLVSGWGQLLDRGATALELMVLNVPRLMTQDCLQQSRKVGDSPNITEYMFC
AGYSDGSKDSCKGDSGGPHATHYRGTWYLTGIVSWGQGCATVGHFGVYTRVS
QYIEWLQKLMRSEPRPGVLLRAPFP |
| FVII variant | 26 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKKLTRAETVKVCPKGECP
WQVLLLVNGAQLCGGTLINTIWVVSAAHCFDKIKNWRNLIAVLGEHDLSEHDG
DEQSRRVAQVIIPSTYVPGTTNHDIALLRLHQPVVLTDHVVPLCLPERTFSERTLA
FVRFSLVSGWGQLLDRGATALELMVLNVPRLMTQDCLQQSRKVGDSPNITEYM
FCAGYSDGSKDSCKGDSGGPHATHYRGTWYLTGIVSWGQGCATVGHFGVYTR
VSQYIEWLQKLMRSEPRPGVLLRAPFP |
| FVII variant | 27 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKDFTRVVGGKVCPKGECP
WQVLLLVNGAQLCGGTLINTIWVVSAAHCFDKIKNWRNLIAVLGEHDLSEHDG
DEQSRRVAQVIIPSTYVPGTTNHDIALLRLHQPVVLTDHVVPLCLPERTFSERTLA
FVRFSLVSGWGQLLDRGATALELMVLNVPRLMTQDCLQQSRKVGDSPNITEYM
FCAGYSDGSKDSCKGDSGGPHATHYRGTWYLTGIVSWGQGCATVGHFGVYTR
VSQYIEWLQKLMRSEPRPGVLLRAPFP |
| FVII variant | 28 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKIQIRSVAKKVCPKGECPW
QVLLLVNGAQLCGGTLINTIWVVSAAHCFDKIKNWRNLIAVLGEHDLSEHDGDE
QSRRVAQVIIPSTYVPGTTNHDIALLRLHQPVVLTDHVVPLCLPERTFSERTLAFV
RFSLVSGWGQLLDRGATALELMVLNVPRLMTQDCLQQSRKVGDSPNITEYMFC
AGYSDGSKDSCKGDSGGPHATHYRGTWYLTGIVSWGQGCATVGHFGVYTRVS
QYIEWLQKLMRSEPRPGVLLRAPFP |
| FVII variant | 29 | NAFLEELRPGSLERECKEEQCSFEEAREIFKDAERTKLFWISYSDGDQCASSPCQN
GGSCKDQLQSYICFCLPAFEGRNCETHKDDQLICVNENGGCEQYCSDHTGTKRS
CRCHEGYSLLADGVSCTPTVEYPCGKIPILEKRNASKPQGRIVGGKVCPKGECPW
QVLLLVNGAQLCGGTLINTIWVVSAAHCFDKIKNWRNLIAVLGEHDLSEHDGDE
QSRRVAQVIIPSTYVPGTTNHDIALLRLHQPVVLTDHVVPLCLPERTFSERTLAFV |

TABLE 2-continued

Factor VII amino acid sequences

| Name | SEQ ID NO: | Amino Acid Sequence |
|---|---|---|
| | | RFSLVSGWGQLLDRGATALELMVLNVPRLMTQDCLQQSRKVGDSPNITEYMFC AGYSDGSKDSCKGDSGGPHATHYRGTWYLTGIVSWGQGCATVGHFGVYTRVS QYIEWLQKLMRSEPRPGVLLRAPFP |
| FVII variant | 30 | ANAFLEELRPGSLERECKEEQCSFEEAREIFKDAERTKLFWISYSDGDQCASSPCQ NGGSCKDQLQSYICFCLPAFEGRNCETHKDDQLICVNENGGCEQYCSDHTGTKR SCRCHEGYSLLADGVSCTPTVEYPCGKIPILEKRNASKIEPRSPSQKVCPKGECPW QVLLLVNGAQLCGGTLINTIWVVSAAHCFDKIKNWRNLIAVLGEHDLSEHDGDE QSRRVAQVIIPSTYVPGTTNHDIALLRLHQPVVLTDHVVPLCLPERTFSERTLAFV RFSLVSGWGQLLDRGATALELMVLNVPRLMTQDCLQQSRKVGDSPNITEYMFC AGYSDGSKDSCKGDSGGPHATHYRGTWYLTGIVSWGQGCATVGHFGVYTRVS QYIEWLQKLMRSEPRPGVLLRAPFP |

III). Coagulation Factor Fusion Protein Compositions

The present invention provides fusion protein compositions comprising coagulation factors (CF). One way to increase the circulation half-life of a therapeutic protein is to reduce the renal clearance of the protein. This may be achieved by conjugating the protein to a polymer that s capable of conferring an increased molecular size (or hydrodynamic radius) to the protein, and hence, reduces renal clearance. Thus, one object of the present invention is to provide improved FIX or FVII (or FVIIa) molecules with a longer circulation, or terminal half-life (thereby decreasing the number of necessary administrations) and that retain at least a portion of the activity of the native coagulation factors, thereby to treat coagulation deficiencies and uncontrolled bleedings more efficiently. In one aspect, the invention provides isolated monomeric fusion proteins of CF comprising the full-length sequence or sequence variants of a CF, such as FIX or FVII, covalently linked to extended recombinant polypeptides ("XTEN" or "XTENs"). As described more fully below, the fusion proteins optionally include spacer sequences that further comprise cleavage sequences to release the CF from the fusion protein when acted on by a protease.

In one aspect, the invention provides an isolated fusion protein comprising at least a first biologically active coagulation factor protein covalently linked to one or more extended recombinant polypeptides ("XTEN"), resulting in a fusion protein composition (hereinafter "CFXTEN"). The term "CFXTEN", as used herein, is meant to encompass fusion polypeptides that comprise one or more payload regions each comprising a biologically active CF that mediates one or more biological or therapeutic activities associated with a coagulation factor and at least one other region comprising at least a first XTEN polypeptide that serves as a carrier. In one embodiment, the coagulation factor is FIX or a sequence variant of FIX, as disclosed above (including sequences with homology to the sequences of Table 1). In another embodiment, the coagulation factor is FVII, which can include the activated form of FVII, or a sequence variant of FVII, as disclosed above (including sequences with homology with the sequences of Table 2). In the case of CFXTEN compositions of the invention comprising FVII, activation of the FVII component may be carried out by exposure to activated factor X, by auto-activation, or according to procedures known in the art, such as those disclosed by Osterud, et al., Biochemistry 11:2853-2857 (1972); Thomas, U.S. Pat. No. 4,456,591; Hedner and Kisiel, J. Clin. Invest. 71:1836-1841 (1983); or Kisiel and Fujikawa, Behring Inst. Mitt. 73:29-42 (1983). Alternatively, factor VII can be activated by passing it through an ion-exchange chromatography column (see, e.g., Bjoern et al. Research Disclosure (1986) 269:564-565), such as Mono Q (Pharmacia fine Chemicals) or similar chromatography resins.

The CF of the subject compositions, particularly those disclosed in Tables 1 and 2, together with their corresponding nucleic acid and amino acid sequences, are well known in the art and descriptions and sequences are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given CF (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a CF to create CFXTEN constructs contemplated by the invention using methods known in the art and/or in conjunction with the guidance and methods provided herein, and described more fully in the Examples.

The CF for inclusion in the CFXTEN of the invention include coagulation factors or sequence variants that are useful, when administered to a subject, for mediating or preventing or ameliorating a disease, disorder or condition associated with bleeding disorders, coagulation factor deficiencies or defects in a coagulation factor. Of particular interest are CFXTEN fusion protein compositions for which an increase in a pharmacokinetic parameter, increased solubility, increased stability, or some other enhanced pharmaceutical property compared to native CF is sought, or for which increasing the terminal half-life would improve efficacy, safety, or result in reduced dosing frequency and/or improve patient compliance. Thus, the CFXTEN fusion protein compositions are prepared with various objectives in mind, including improving the therapeutic efficacy of the bioactive CF by, for example, increasing the in vivo exposure or the length that the CFXTEN remains within the therapeutic window when administered to a subject, compared to a CF not linked to XTEN.

In one embodiment, the CF incorporated into the subject compositions can be a recombinant polypeptide with a sequence corresponding to a protein found in nature. In another embodiment, the CF is a sequence variant, fragment, homolog, or mimetic of a natural sequence that retain at least a portion of the biological activity of the native CF. In non-limiting examples, a CF is a sequence that exhibits at least about 80% sequence identity, or alternatively 81%, 82%, 83%, 84%, 85%, 86%, 87%, 88%, 89%, 90%, 91%, 92%, 93%, 94%, 95%. 96%, 97%, 98%, or at least about 99%, or 100% sequence identity compared to a protein sequence selected from Table 1 or from Table 2. In one embodiment, a CFXTEN fusion protein comprises a single CF molecule linked to a single XTEN (e.g., an XTEN as described more fully below). In another embodiment, the CFXTEN comprises a first CF and a second molecule of the same CF, resulting in a fusion protein comprising the two CF linked to one or more XTEN in an N- to C-terminus configuration selected from Table 6. In another embodiment, the CFXTEN fusion protein comprises a single CF molecule linked to a first and a second XTEN, in which the CF is a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to a protein sequence selected from Table 1 or from Table 2, and the first and/or the second XTEN are sequences that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to a sequence selected from Table 4.

The subject CFXTEN of the present invention exhibits an enhancement of one or more pharmacokinetic parameters compared to the native CF. The CFXTEN with enhanced pharmacokinetic parameters permits less frequent dosing or an enhanced pharmacologic effect, including but not limited to maintaining the biologically active CFXTEN within the therapeutic window between the minimum effective dose or blood concentration ($C_{min}$) and the maximum tolerated dose or blood concentration ($C_{max}$) for a longer period of time compared to the CF not linked to XTEN. In such cases, the linking of the CF to a fusion protein comprising a select XTEN sequence(s) can result in an improvement in these properties, making them more useful as therapeutic or preventive agents compared to CF not linked to XTEN. In some embodiments, the subject CFXTEN of the present invention has a cleavage sequence incorporated between the CF and the XTEN and the biologic activity of the CF component is enhanced by the release of the CF from the fusion protein by cleavage of the cleavage sequence by an endogenous protease, as described below.

IV). Xtended Recombinant Polypeptides

In one aspect, the invention provides XTEN polypeptide compositions that are useful as a fusion protein partner to which CF is linked, resulting in a CFXTEN fusion protein. XTEN are generally extended length polypeptides with non-naturally occurring, substantially non-repetitive sequences that are composed mainly of small hydrophilic amino acids, with the sequence having a low degree or no secondary or tertiary structure under physiologic conditions.

XTENs have utility as a fusion protein partners in that they serve as a "carrier," conferring certain desirable pharmacokinetic, physicochemical and pharmaceutical properties when linked to a CF protein to a create a fusion protein. Such desirable properties include but are not limited to enhanced pharmacokinetic parameters and solubility characteristics of the compositions, amongst other properties described herein. Such fusion protein compositions have utility to treat certain coagulation factor-related diseases, disorders or conditions, as described herein. As used herein, "XTEN" specifically excludes whole antibodies or antibody fragments (e.g. single-chain antibodies and Fc fragments).

In some embodiments, the XTEN is a long polypeptide having greater than about 100 to about 3000 amino acid residues when used as a carrier or greater than 400 to about 3000 residues cumulatively when more than one XTEN unit is used in a single fusion protein. In other embodiments, when XTEN is used as a linker between fusion protein components or where an increase in half-life of the fusion protein is not needed but where an increase in solubility or some other physico/chemical property for the CF fusion partner component is desired, an XTEN sequence shorter than 100 amino acid residues, such as about 96, or about 84, or about 72, or about 60, or about 48, or about 36 amino acid residues are incorporated into a fusion protein composition with the CF to effect the property.

The selection criteria for the XTEN to be linked to the biologically active proteins used to create the inventive fusion proteins compositions generally relate to attributes of physical/chemical properties and conformational structure of the XTEN that is, in turn, used to confer enhanced pharmaceutical and pharmacokinetic properties to the fusion proteins compositions. The XTEN of the present invention exhibits one or more of the following advantageous properties: conformational flexibility, enhanced aqueous solubility, high degree of protease resistance, low immunogenicity, low binding to mammalian receptors, and increased hydrodynamic (or Stokes) radii; properties that make them particularly useful as fusion protein partners. Non-limiting examples of the properties of the fusion proteins comprising CF that are enhanced by XTEN include increases in the overall solubility and/or metabolic stability, reduced susceptibility to proteolysis, reduced immunogenicity, reduced rate of absorption when administered subcutaneously or intramuscularly, and enhanced pharmacokinetic properties such as longer terminal half-life and increased area under the curve (AUC), slower absorption after subcutaneous or intramuscular injection (compared to CF not linked to XTEN and administered by a similar route) such that the $C_{max}$ is lower, which, in turn, results in reductions in adverse effects of the CF that, collectively, results in an increased period of time that a fusion protein of a CFXTEN composition administered to a subject retains therapeutic activity.

A variety of methods and assays are known in the art for determining the physical/chemical properties of proteins such as the compositions comprising the inventive XTEN. Such properties include but are not limited to secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau, et al., Prot Expr and Purif (2006) 48, 1-13.

In one embodiment, XTEN is designed to behave like denatured peptide sequence under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD)

spectra and are characterized by a lack of long-range interactions as determined by NMR. "Denatured conformation" and "unstructured conformation" are used synonymously herein. In some embodiments, the invention provides XTEN sequences that, under physiologic conditions, resemble denatured sequences that are largely devoid in secondary structure. In other cases, the XTEN sequences are substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the methods described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) Biochemistry, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some embodiments, the XTEN sequences used in the subject fusion protein compositions can have an alpha-helix percentage ranging from 0% to less than about 5% as determined by the Chou-Fasman algorithm. In other cases, the XTEN sequences of the fusion protein compositions have a beta-sheet percentage ranging from 0% to less than about 5% as determined by the Chou-Fasman algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm. In some embodiments, the XTEN sequences of the fusion protein compositions have an alpha-helix percentage less than about 2% and a beta-sheet percentage less than about 2%. In other cases, the XTEN sequences of the fusion protein compositions have a high degree of random coil percentage, as determined by the GOR algorithm. In some embodiments, an XTEN sequence have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by the GOR algorithm.

1. Non-Repetitive Sequences

In some embodiments, XTEN sequences of the compositions are substantially non-repetitive. In general, repetitive amino acid sequences have a tendency to aggregate or form higher order structures, as exemplified by natural repetitive sequences such as collagens and leucine zippers. These repetitive amino acids may also tend to form contacts resulting in crystalline or pseudocrystaline structures. In contrast, the low tendency of non-repetitive sequences to aggregate enables the design of long-sequence XTENs with a relatively low frequency of charged amino acids that would otherwise be likely to aggregate if the sequences were repetitive. Typically, the CFXTEN fusion proteins comprise XTEN sequences of greater than about 100 to about 3000 amino acid residues wherein the sequences are substantially non-repetitive. In one embodiment, the XTEN sequences have greater than about 100 to about 3000 amino acid residues in which no three contiguous amino acids in the sequence are identical amino acid types unless the amino acid is serine, in which case no more than three contiguous amino acids are serine residues. In the foregoing embodiment, the XTEN sequence is "substantially non-repetitive."

The degree of repetitiveness of a polypeptide or a gene can be measured by computer programs or algorithms or by other means known in the art. Repetitiveness in a polypeptide sequence can, for example, be assessed by determining the number of times shorter sequences of a given length occur within the polypeptide. For example, a polypeptide of 200 amino acid residues has 192 overlapping 9-amino acid sequences (or 9-mer "frames") and 198 3-mer frames, but the number of unique 9-mer or 3-mer sequences will depend on the amount of repetitiveness within the sequence. A score is generated (hereinafter "subsequence score") that is reflective of the degree of repetitiveness of the subsequences in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 44. In some embodiments, the present invention provides CFXTEN each comprising one or more XTEN in which the XTEN has a subsequence score less than 12, more preferably less than 10, more preferably less than 9, more preferably less than 8, more preferably less than 7, more preferably less than 6, and most preferably less than 5. In the embodiments hereinabove described in this paragraph, an XTEN with a subsequence score less than about 10 (i.e., 9, 8, 7, etc.) is "substantially non-repetitive."

The non-repetitive characteristic of XTEN imparts a CF fusion proteins a greater degree of solubility and less tendency to aggregate compared to polypeptides having repetitive sequences. These properties facilitate the formulation of XTEN-comprising pharmaceutical preparations containing extremely high drug concentrations, in some cases exceeding 100 mg/ml.

Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345: 1365-71; Hsu, C. T., et al. (2000) Cancer Res, 60:3701-5; Bachmann M F, et al. Eur J Immunol. (1995) 25(12):3445-3451).

2. Exemplary Sequence Motifs

The present invention encompasses XTEN used as fusion partners that comprise multiple units of shorter sequences, or motifs, in which the amino acid sequences of the motifs are non-repetitive. The non-repetitive criterion can be met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is rendered substantially non-repetitive.

In one embodiment, XTEN have a non-repetitive sequence of greater than about 100 to about 3000 amino acid residues wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly of small hydrophilic amino acids, such that the overall sequence has an unstructured, flexible characteristic. Examples of amino acids that are included in XTEN are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In one embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 100 to about 3000 amino acid residues, preferably greater than 400 to about 3000 residues in length. In some embodiments, XTEN have sequences of greater than about 100 to about 3000 amino acid residues wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein the content of any one amino acid type in the full-length XTEN does not exceed 30%.

In still other embodiments, XTENs comprise non-repetitive sequences of greater than about 100 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences is substantially non-repetitive.

In some embodiments, the invention provides compositions comprising non-repetitive XTEN sequence(s) of greater than about 100 to about 3000 amino acid residues wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 3. In some embodiments, the XTEN comprises non-overlapping sequence motifs in which about 80%, or at least about 90%, or about 91%, or about 92%, or about 93%, or about 94%, or about 95%, or about 96%, or about 97%, or about 98%, or about 99% to about 100% of the sequence consists of two or more non-overlapping sequences selected from a single motif family of Table 3, resulting in a "family" sequence in which the overall sequence remains substantially non-repetitive. Accordingly, in these embodiments, an XTEN sequence comprises multiple units of non-overlapping sequence motifs of the AD motif family, or the AE motif family, or the AF motif family, or the AG motif family, or the AM motif family, or the AQ motif family, or the BC family, or the BD family of sequences of Table 3. In other embodiments, the XTEN comprises motif sequences from two or more of the motif families of Table 3.

TABLE 3

XTEN Sequence Motifs of 12 Amino Acids and Motif Families

| Motif Family* | SEQ ID NO: | MOTIF SEQUENCE |
|---|---|---|
| AD | 31 | GESPGGSSGSES |
| AD | 32 | GSEGSSGPGESS |
| AD | 33 | GSSESGSSEGGP |
| AD | 34 | GSGGEPSESGSS |
| AE, AM | 35 | GSPAGSPTSTEE |
| AE, AM, AQ | 36 | GSEPATSGSETP |
| AE, AM, AQ | 37 | GTSESATPESGP |
| AE, AM, AQ | 38 | GTSTEPSEGSAP |
| AF, AM | 39 | GSTSESPSGTAP |
| AF, AM | 40 | GTSTPESGSASP |
| AF, AM | 41 | GTSPSGESSTAP |
| AF, AM | 42 | GSTSSTAESPGP |
| AG, AM | 43 | GTPGSGTASSSP |
| AG, AM | 44 | GSSTPSGATGSP |
| AG, AM | 45 | GSSPSASTGTGP |
| AG, AM | 46 | GASPGTSSTGSP |
| AQ | 47 | GEPAGSPTSTSE |
| AQ | 48 | GTGEPSSTPASE |
| AQ | 49 | GSGPSTESAPTE |
| AQ | 50 | GSETPSGPSETA |
| AQ | 51 | GPSETSTSEPGA |
| AQ | 52 | GSPSEPTEGTSA |
| BC | 53 | GSGASEPTSTEP |
| BC | 54 | GSEPATSGTEPS |
| BC | 55 | GTSEPSTSEPGA |
| BC | 56 | GTSTEPSEPGSA |
| BD | 57 | GSTAGSETSTEA |
| BD | 58 | GSETATSGSETA |
| BD | 59 | GTSESATSESGA |
| BD | 60 | GTSTEASEGSAS |

*Denotes individual motif sequences that, when used together in various permutations, results in a "family sequence"

In other embodiments, the CFXTEN composition comprises a non-repetitive XTEN sequence of greater than about 100 to about 3000 amino acid residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 9-12.

In those embodiments wherein the XTEN component of the CFXTEN fusion protein has less than 100% of its amino acids consisting of four to six amino acid selected from glycine (G), alanine (A), serine (S), threonine (T), glutamate (E) and proline (P), or less than 100% of the sequence consisting of the sequence motifs of Table 3, or less than 100% sequence identity compared with an XTEN from Table 3, the other amino acid residues are selected from any other of the 14 natural L-amino acids, but are preferentially selected from hydrophilic amino acids such that the XTEN sequence contains at least about 90%, or at least about 91%, or at least about 92%, or at least about 93%, or at least about 94%, or at least about 95%, or at least about 96%, or at least about 97%, or at least about 98%, or at least about 99% hydrophilic amino acids. The XTEN amino acids that are not glycine (G), alanine (A), serine (S), threonine (T), glutamate (E) and proline (P) are interspersed throughout the XTEN sequence, are located within or between the sequence motifs, or are concentrated in one or more short stretches of the XTEN sequence. In such cases where the XTEN component of the CFXTEN comprises amino acids other than glycine (G), alanine (A), serine (S), threonine (T), glutamate (E) and proline (P), it is preferred that the amino acids not be hydrophobic residues and should not substantially confer secondary structure of the XTEN component. Hydrophobic residues that are less favored in construction of XTEN include tryptophan, phenylalanine, tyrosine, leucine, isoleucine, valine, and methionine. Additionally, one can design the XTEN sequences to contain few (e.g. less than 5%) or none of the following amino acids: cysteine (to avoid disulfide formation and oxidation), methionine (to avoid oxidation), asparagine and glutamine (to avoid desamidation). Thus, in some embodiments, the XTEN component of the CFXTEN fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by the Chou-Fasman algorithm and have at least 90%, or at least about 95% or more random coil formation as measured by the GOR algorithm.

3. Length of Sequence

In another aspect of the present invention, the invention encompasses CFXTEN compositions comprising carriers of XTEN polypeptides with extended length sequences. The present invention makes use of the discovery that increasing the length of the non-repetitive, unstructured polypeptides enhances the unstructured nature of the XTENs and correspondingly enhances the biological and pharmacokinetic properties of fusion proteins comprising the XTEN carrier. As described more fully in the Examples, proportional increases in the length of the XTEN, even if created by a fixed repeat order of single family sequence motifs (e.g., the four AE motifs of Table 3), result in a sequence with a higher percentage of random coil formation, as determined by GOR algorithm, compared to shorter XTEN lengths. In general, increasing the length of the unstructured polypeptide fusion partner, as described in the Examples, results in a fusion protein with a disproportionate increase in terminal half-life compared to fusion proteins with unstructured polypeptide partners with shorter sequence lengths.

Non-limiting examples of XTEN contemplated for inclusion in the CFXTEN of the invention are presented in Table 4, below. In one embodiment, the invention provides CFXTEN compositions wherein the XTEN sequence length of the fusion protein(s) is greater than about 100 to about 3000 amino acid residues, and in some cases is greater than 400 to about 3000 amino acid residues, wherein the XTEN confers enhanced pharmacokinetic properties on the CFXTEN in comparison to CF not linked to XTEN. In some embodiments, the XTEN sequences of the CFXTEN compositions of the present invention can be about 100, or about 144, or about 288, or about 401, or about 500, or about 600, or about 700, or about 800, or about 900, or about 1000, or about 1500, or about 2000, or about 2500 or up to about 3000 amino acid residues in length. In other cases, the XTEN sequences can be about 100 to 150, about 150 to 250, about 250 to 400, 401 to about 500, about 500 to 900, about 900 to 1500, about 1500 to 2000, or about 2000 to about 3000 amino acid residues in length. In one embodiment, the CFXTEN can comprise an XTEN sequence wherein the sequence exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a XTEN selected from Table 4. In some embodiments, the XTEN sequence is designed for optimized expression as the N-terminal component of the CFXTEN by inclusion of encoding nucleotides for an optimized N-terminal leader sequence (NTS) in the XTEN portion of the gene encoding the fusion protein. In one embodiment, the N-terminal XTEN sequence of the expressed CFXTEN has at least 90% sequence identity compared to the sequence of AE48 or AM48, AE624, or AE912 or AM923. In another embodiment, the XTEN has the N-terminal residues described in Examples 14-17.

In other embodiments, the CFXTEN fusion protein comprises a first and a second XTEN sequence, wherein the cumulative total of the residues in the XTEN sequences is greater than about 400 to about 3000 amino acid residues and the XTEN can be identical or they can be different in sequence. In embodiments of the foregoing, the CFXTEN fusion protein comprises a first and a second XTEN sequence wherein the sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to at least a first or additionally a second XTEN selected from Table 4. Examples where more than one XTEN is used in a CFXTEN composition include, but are not limited to constructs with an XTEN linked to both the N- and C-termini of at least one CF.

As described more fully below, the invention provides methods in which the CFXTEN is designed by selecting the length of the XTEN to confer a target half-life on a fusion protein administered to a subject. In general, XTEN lengths longer that about cumulative 400 residues incorporated into the CFXTEN compositions result in longer half-life compared to shorter cumulative lengths; e.g., shorter than about 280 residues. However, in another embodiment, CFXTEN fusion proteins are designed to comprise XTEN with a longer sequence length that is selected to additionally confer slower rates of systemic absorption after subcutaneous or intramuscular administration to a subject. In such embodiments, the $C_{max}$ is reduced in comparison to a comparable dose of a CF not linked to XTEN, thereby contributing to the ability to keep the CFXTEN within the therapeutic window for the composition. Thus, the XTEN confers the property of a depot to the administered CFXTEN, in addition to the other physical/chemical properties described herein.

TABLE 4

XTEN Polypeptides

| XTEN Name | SEQ ID NO: | Amino Acid Sequence |
|---|---|---|
| AE48 | 61 | MAEPAGSPTSTEEGTPGSGTASSSPGSSTPSGATGSPGASPGTSSTGS |
| AM48 | 62 | MAEPAGSPTSTEEGASPGTSSTGSPGSSTPSGATGSPGSSTPSGATGS |
| AE144 | 63 | GSEPATSGSETPGTSESATPESGPGSEPATSGSETPGSPAGSPTSTEEGTSTEPSEGS APGSEPATSGSETPGSEPATSGSETPGSEPATSGSETPGTSTEPSEGSAPGTSESAT PESGPGSEPATSGSETPGTSTEPSEGSAP |
| AF144 | 64 | GTSTPESGSASPGTSPSGESSTAPGTSPSGESSTAPGSTSSTAESPGPGSTSESPSGT APGSTSSTAESPGPGTSPSGESSTAPGTSTPESGSASPGSTSSTAESPGPGTSPSGES STAPGTSPSGESSTAPGTSPSGESSTAP |
| AE288 | 65 | GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGT STEPSEGSAPGTSTEPSEGSAPGSEPATSGSETPGTSESATPESGPGTSTEPSEGSAP |

TABLE 4-continued

XTEN Polypeptides

| XTEN Name | SEQ ID NO: | Amino Acid Sequence |
|---|---|---|
| AF504 | 66 | GASPGTSSTGSPGSSPSASTGTGPGSSPSASTGTGPGTPGSGTASSSPGSSTPSGAT GSPGSXPSASTGTGPGASPGTSSTGSPGTPGSGTASSSPGSSTPSGATGSPGTPGSG TASSSPGASPGTSSTGSPGASPGTSSTGSPGTPGSGTASSSPGSSTPSGATGSPGAS PGTSSTGSPGTPGSGTASSSPGSSTPSGATGSPGSXPSASTGTGPGSSPSASTGTGP GSSTPSGATGSPGSSTPSGATGSPGASPGTSSTGSPGASPGTSSTGSPGASPGTSST GSPGTPGSGTASSSPGASPGTSSTGSPGASPGTSSTGSPGASPGTSSTGSPGSSPSA STGTGPGTPGSGTASSSPGASPGTSSTGSPGASPGTSSTGSPGASPGTSSTGSPGSS TPSGATGSPGSSTPSGATGSPGASPGTSSTGSPGTPGSGTASSSPGSSTPSGATGSP GSSTPSGATGSPGSSTPSGATGSPGSSPSASTGTGPGASPGTSSTGSP |
| AF540 | 67 | GSTSSTAESPGPGSTSSTAESPGPGSTSESPSGTAPGSTSSTAESPGPGSTSSTAESP GPGTSTPESGSASPGSTSESPSGTAPGTSPSGESSTAPGSTSESPSGTAPGSTSESPS GTAPGTSPSGESSTAPGSTSESPSGTAPGSTSESPSGTAPGTSPSGESSTAPGSTSES PSGTAPGSTSESPSGTAPGSTSESPSGTAPGTSTPESGSASPGSTSESPSGTAPGTST PESGSASPGSTSSTAESPGPGSTSSTAESPGPGTSTPESGSASPGTSTPESGSASPGS TSESPSGTAPGTSTPESGSASPGTSTPESGSASPGSTSESPSGTAPGSTSESPSGTAP GSTSESPSGTAPGSTSSTAESPGPGTSTPESGSASPGTSTPESGSASPGSTSESPSGT APGSTSESPSGTAPGTSTPESGSASPGTSESPSGTAPGSTSESPSGTAPGTSTPESG SASPGTSPSGESSTAPGSTSSTAESPGPGTSPSGESSTAPGSTSSTAESPGPGTSTPE SGSASPGSTSESPSGTAP |
| AD576 | 68 | GSSESGSSEGGPGSGGEPSESGSSGSSSESGSSEGGPGSSESGSSEGGPGSSESGSSE GGPGSSESGSSEGGPGSSESGSSEGGPGSESPGGSSGSESGSEGSSGPGESSGSSESG SSEGGPGSSESGSSEGGPGSSESGSSEGGPGSGGEPSESGSSGSESPGGSSGSESGES PGGSSGSESGSSGGEPSESGSSGSSSESGSSEGGPGSGGEPSESGSSGSGGEPSESGSS GSEGSSGPGESSGESPGGSSGSESGSSGGEPSESGSSGSGGEPSESGSSGSGGEPSES GSSGSSESGSSEGGPGESPGGSSGSESGESPGGSSGSESGESPGGSSGSESGESPGG SSGSESGESPGGSSGSESGSSEGGPGSGGEPSESGSSGSESGSSGPGESSGSS ESGSSEGGPGSGGEPSESGSSGSSSESGSSEGGPGSGGEPSESGSSGESPGGSSGSES GESPGGSSGSESGSSESGSSEGGPGSGGEPSESGSSGSSESGSSEGGPGSGGEPSES GSSGSGGEPSESGSSGESPGGSSGSESGSEGSSGPGESSGSSESGSSEGGPGSEGSS GPGESS |
| AE576 | 69 | GSPAGSPTSEEGTSESATPESGPGTSTEPSEGSAPGSPAGSPTSEEGTSTEPSEGS APGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSEEGTSTE PSEGSAPGTSTEPSEGSAPGTSESATPESGPGTSTEPSEGSAPGTSESATPESGPGSE PATSGSETPGTSTEPSEGSAPGTSTEPSEGSAPGTSESATPESGPGTSESATPESGP GSPAGSPTSTEEGTSESATPESGPGSEPATSGSETPGTSESATPESGPGTSTEPSEGS APGTSTEPSEGSAPGTSTEPSEGSAPGTSTEPSEGSAPGTSTEPSEGSAPGTSTEPSE GSAPGSPAGSPTSTEEGTSTEPSEGSAPGTSESATPESGPGSEPATSGSETPGTSESA ATPESGPGSEPATSGSETPGTSESATPESGPGTSTEPSEGSAPGTSESATPESGPGSP AGSPTSTEEGSPAGSPTSTEEGSPAGSPTSTEEGTSESATPESGPGTSTEPSEGSAP |
| AF576 | 70 | GSTSSTAESPGPGSTSSTAESPGPGSTSESPSGTAPGSTSSTAESPGPGSTSSTAESP GPGTSTPESGSASPGSTSESPSGTAPGTSPSGESSTAPGSTSESPSGTAPGSTSESPS GTAPGTSPSGESSTAPGSTSESPSGTAPGSTSESPSGTAPGTSPSGESSTAPGSTSES PSGTAPGSTSESPSGTAPGSTSESPSGTAPGTSTPESGSASPGSTSESPSGTAPGTST PESGSASPGSTSSTAESPGPGSTSSTAESPGPGTSTPESGSASPGTSTPESGSASPGS TSESPSGTAPGTSTPESGSASPGTSTPESGSASPGSTSESPSGTAPGSTSESPSGTAP GSTSESPSGTAPGSTSSTAESPGPGTSTPESGSASPGTSTPESGSASPGSTSESPSGT APGSTSESPSGTAPGTSTPESGSASPGTSESPSGTAPGSTSESPSGTAPGTSTPESG SASPGTSPSGESSTAPGSTSSTAESPGPGTSPSGESSTAPGSTSSTAESPGPGTSTPE SGSASPGSTSESPSGTAPGSTSSTAESPGPGTSTPESGSASPGTSTPESGSASP |
| AE624 | 71 | MAEPAGSPTSTEEGTPGSGTASSSPGSSTPSGATGSPGASPGTSSTGSPGSPAGSPT STEEGTSESATPESGPGTSTEPSEGSAPGSPAGSPTSTEEGTSTEPSEGSAPGTSTEP SEGSAPGTSESATPESGPGSEPATSGSETPGSEPATSGSETPGSPAGSPTSTEEGTS ESATPESGPGTSTEPSEGSAPGTSTEPSEGSAPGSPAGSPTSTEEGTSTEPSEGSAP GTSTEPSEGSAPGTSESATPESGPGTSTEPSEGSAPGTSESATPESGPGSEPATSGS ETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTE PSEGSAPGTSTEPSEGSAPGTSTEPSEGSAPGTSTEPSEGSAPGTSTEPSEGSAPGSP AGSPTSTEEGTSTEPSEGSAPGTSESATPESGPGSEPATSGSETPGTSESATPESGP GSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAP |
| AD836 | 72 | GSSESGSSEGGPGSSESGSSEGGPGESPGGSSGSESGSGGEPSESGSSGESPGGSG SESGESPGGSGSESGSSESGSSEGGPGSSESGSSEGGPGSSESGSSEGGPGESPGG SSGSESGESPGGSSGSESGESPGGSSGSESGSSESGSSESGSSEGGPGSS ESGSSEGGPGSSESGSSEGGPGSSESGSSEGGPGSSESGSSEGGPGSGGEPSESGSS GESPGGSSGSESGESPGGSSGSESGSSGGEPSESGSSGSEGSSGPGESSGSSESGSSE GGPGSGGEPSESGSSGSEGSSGPGESSGSSESGSSEGGPGSGGEPSESGSSGESPGG SSGSESGSGGEPSESGSSGSGGEPSESGSSGSSESGSSEGGPGSGGEPSESGSSGSG GEPSESGSSGSEGSSGPGESSGSEGSSGPGESSGSEGSSGPGESSGSEGSSGPGESS |

TABLE 4-continued

XTEN Polypeptides

| XTEN Name | SEQ ID NO: | Amino Acid Sequence |
|---|---|---|
| | | GSGGEPSESGSSGSSESGSSEGGPGSSESGSSEGGPGESPGGSSGSESGSGGEPSES GSSSGSEGSSGPGESSGESPGGSSGSESGSEGSSGPGSSESGSSEGGPGSGGEPSESG SSGSEGSSGPGESSGESSGPGESSGSEGSSGPGESSGSGGEPSESGSSGSGGEPS ESGSSGESPGGSSGSESGESPGGSSGSESGSGGEPSESGSSGSEGSSGPGESSGESP GGSSGSESGSSESGSSEGGPGSSESGSSEGGPGSSESGSSEGGPGSGGEPSESGSSG SSESGSSEGGPGESPGGSSGSESGSGGEPSESGSSGSSESGSSEGGPGESPGGSSGS ESGSGGEPSESGSSGESPGGSSGSESGSGGEPSESGSS |
| AE864 | 73 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTE PSEGSAPGTSTEPSEGSAPGTSESATPESGPGTSTEPSEGSAPGTSESATPESGPGSE PATSGSETPGTSTEPSEGSAPGTSTEPSEGSAPGTSESATPESGPGTSESATPESGP GSPAGSPTSTEEGTSESATPESGPGSEPATSGSETPGTSESATPESGPGTSTEPSEGS APGTSTEPSEGSAPGTSTEPSEGSAPGTSTEPSEGSAPGTSTEPSE GSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSP AGSPTSTEEGSPAGSPTSTEEGSPAGSPTSTEEGTSESATPESGPGTSTEPSEGSAP GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGT STEPSEGSAPGTSTEPSEGSAPGSEPATSGSETPGTSESATPESGPGTSTEPSEGSAP |
| AF864 | 74 | GSTSESPSGTAPGTSPSGESSTAPGSTSESPSGTAPGSTSESPSGTAPGTSTPESGSA SPGTSTPESGSASPGSTSESPSGTAPGSTSESPSGTAPGTSPSGESSTAPGSTSESPS GTAPGTSPSGESSTAPGTSPSGESSTAPGSTSSTAESPGPGTSPSGESSTAPGTSPSG ESSTAPGSTSSTAESPGPGTSTPESGSASPGTSTPESGSASPGSTSESPSGTAPGSTS ESPSGTAPGTSTPESGSASPGSTSSTAESPGPGTSTPESGSASPGSTSESPSGTAPGT SPSGESSTAPGSTSSTAESPGPGTSPSGESSTAPGTSTPESGSASPGSTSSTAESPGP GSTSSTAESPGPGSTSSTAESPGPGTSPSGESSTAPGSTSESPSGT APGSTSESPSGTAPGTSTPESGPXXXGASASGAPSTXXXXSESPSGTAPGSTSESP SGTAPGSTSESPSGTAPGSTSESPSGTAPGSTSESPSGTAPGTSTP ESGSASPGTSPSGESSTAPGTSPSGESSTAPGSTSSTAESPGPGTSPSGESSTAPGTS TPESGSASPGSTSESPSGTAPGSTSESPSGTAPGTSPSGESSTAPGSTSESPSGTAPG TSTPESGSASPGTSTPESGSASPGSTSESPSGTAPGTSTPESGSASPGSTSSTAESPG PGSTSESPSGTAPGSTSESPSGTAPGTSPSGESSTAPGSTSSTAESPGPGTSPSGESS TAPGTSTPESGSASPGTSPSGESSTAPGTSPSGESSTAPGSTSSTA ESPGPGTSSTAESPGPGTSPSGESSTAPGSSPSASTGTGPGSSTPSGATGSPGSSTP SGATGSP |
| AG864 | 75 | GASPGTSSTGSPGSSPSASTGTGPGSSPSASTGTGPGTPGSGTASSSPGSSTPSGAT GSPGSSPSASTGTGPGASPGTSSTGSPGTPGSGTASSSPGSSTPSGATGSPGTPGSG TASSSPGASPGTSSTGSPGASPGTSSTGSPGTPGSGTASSSPGSSTPSGATGSPGAS PGTSSTGSPGTPGSGTASSSPGSSTPSGATGSPGSSPSASTGTGPGSSPSASTGTGP GSSTPSGATGSPGSSTPSGATGSPGASPGTSSTGSPGASPGTSSTGSPGASPGTSST GSPGTPGSGTASSSPGASPGTSSTGSPGASPGTSSTGSPGASPGTSSTGSPGSSPSA STGTGPGTPGSGTASSSPGASPGTSSTGSPGASPGTSSTGSPGASPGTSSTGSPGSS TPSGATGSPGSSTPSGATGSPGASPGTSSTGSPGTPGSGTASSSPGSSTPSGATGSP GSSTPSGATGSPGSSTPSGATGSPGSSPSASTGTGPGASPGTSSTGSPGASPGTSST GSPGTPGSGTASSSPGASPGTSSTGSPGASPGTSSTGSPGASPGTSSTGSPGASPGT SSTGSPGTPGSGTASSSPGSSTPSGATGSPGTPGSGTASSSPGSSTPSGATGSPGTP GSGTASSSPGSSTPSGATGSPGSSTPSGATGSPGSSPSASTGTGPGSSPSASTGTGP GASPGTSSTGSPGTPGSGTASSSPGSSTPSGATGSPGSSPSASTGTGPGSSPSASTG TGPGASPGTSSTGSPGASPGTSSTGSPGSSTPSGATGSPGSSPSASTGTGPGASPGT SSTGSPGSSPSASTGTGPGTPGSGTASSSPGSSTPSGATGSPGSSTPSGATGSPGAS PGTSSTGSP |
| AM875 | 76 | GTSTEPSEGSAPGSEPATSGSETPGSPAGSPTSTEEGSTSSTAESPGPGTSTPESGSA SPGSTSESPSGTAPGSTSESPSGTAPGTSTPESGSASPGTSTPESGSASPGSEPATSG SETPGTSESATPESGPGSPAGSPTSTEEGTSTEPSEGSAPGTSESATPESGPGTSTEP SEGSAPGTSTEPSEGSAPGSPAGSPTSTEEGTSTEPSEGSAPGTSTEPSEGSAPGTS ESATPESGPGTSESATPESGPGTSTEPSEGSAPGTSTEPSEGSAPGTSESATPESGP GTSTEPSEGSAPGSEPATSGSETPGSPAGSPTSTEEGSSTPSGATGSPGTPGSGTAS SSPGSSTPSGATGSPGTSTEPSEGSAPGTSTEPSEGSAPGSEPATSGSETPGSPAGSP TSTEEGSPAGSPTSTEEGTSTEPSEGSAPGASASGAPSTSESATPESGPGSPAG SPTSTEEGSPAGSPTSTEEGSTSSTAESPGPGTSPSGESSTAPGTP GSGTASSSPGSSTPSGATGSPGSSPSASTGTGPGSEPATSGSETPGTSESATPESGP GSEPATSGSETPGSTSSTAESPGPGTSSTAESPGPGTSPSGESSTAPGSEPATSGSE TPGSEPATSGSETPGTSTEPSEGSAPGSTSSTAESPGPGTSPSGESSTAPGSTSESPS GTAPGSTSEPSEGSAPGTSTEPSEGSAPGTSTEPSEGSAPGSSTPSGATGSPGSSPS ASTGTGPGASPGTSSTGSPGSEPATSGSETPGTSESATPESGPGSPAGSPTSTEEGS STPSGATGSPGSSPSASTGTGPGASPGTSSTGSPGTSESATPESGPGTSTEPSEGSA PGTSTEPSEGSAP |

TABLE 4-continued

XTEN Polypeptides

| XTEN Name | SEQ ID NO: | Amino Acid Sequence |
|---|---|---|
| AE912 | 77 | MAEPAGSPTSTEEGTPGSGTASSSPGSSTPSGATGSPGASPGTSSTGSPGSPAGSPT
STEEGTSESATPESGPGTSTEPSEGSAPGSPAGSPTSTEEGTSTEPSEGSAPGTSTEP
SEGSAPGTSESATPESGPGSEPATSGSETPGSEPATSGSETPGSPAGSPTSTEEGTS
ESATPESGPGTSTEPSEGSAPGTSTEPSEGSAPGSPAGSPTSTEEGTSTEPSEGSAP
GTSTEPSEGSAPGTSESATPESGPGTSTEPSEGSAPGTSESATPESGPGSEPATSGS
ETPGTSTEPSEGSAPGTSTEPSEGSAPGTSESATPESGPGTSESATPESGPGSPAGSP
TSTEEGTSESATPESGPGSEPATSGSETPGTSESATPESGPGTSTEPSEGSAPGTSTE
PSEGSAPGTSTEPSEGSAPGTSTEPSEGSAPGTSTEPSEGSAPGTSTEPSEGSAPGSP
AGSPTSTEEGTSTEPSEGSAPGTSESATPESGPGSEPATSGSETPGTSESATPESGP
GSEPATSGSETPGTSESATPESGPGTSTEPSEGSAPGTSESATPESGPGSPAGSPTST
EEGSPAGSPTSTEEGSPAGSPTSTEEGTSESATPESGPGTSTEPSEGSAPGTSESATP
ESGPGSEPATSGSETPGTSESATPESGPGSPAGSETPGTSESATPESGPGTSTEP
SEGSAPGSPAGSPTSTEEGTSESATPESGPGSEPATSGSETPGTSESATPESGPGSP
AGSPTSTEEGSPAGSPTSTEEGTSTEPSEGSAPGTSESATPESGPGTSESATPESGP
GTSESATPESGPGSEPATSGSETPGSEPATSGSETPGSPAGSPTSTEEGTSTEPSEGS
APGTSTEPSEGSAPGSEPATSGSETPGTSESATPESGPGTSTEPSEGSAP |
| AM923 | 78 | MAEPAGSPTSTEEGASPGTSSTGSPGSSTPSGATGSPGSSTPSGATGSPGTSTEPSE
GSAPGSEPATSGSETPGSPAGSPTSTEEGSTSSTAESPGPGTSTPESGSASPGSTSES
PSGTAPGSTSESPSGTAPGTSTPESGSASPGTSTPESGSASPGSEPATSGSETPGTSE
SATPESGPGSPAGSPTSTEEGTSTEPSEGSAPGTSESATPESGPGTSTEPSEGSAPG
TSTEPSEGSAPGSPAGSPTSTEEGTSTEPSEGSAPGTSTEPSEGSAPGTSESATPESG
PGTSESATPESGPGTSTEPSEGSAPGTSTEPSEGSAPGTSESATPESGPGTSTEPSEG
SAPGSEPATSGSETPGSPAGSPTSTEEGSSTPSGATGSPGTPGSGTASSSPGSSTPS
GATGSPGTSTEPSEGSAPGTSTEPSEGSAPGSEPATSGSETPGSPAGSPTSTEEGSP
AGSPTSTEEGTSTEPSEGSAPGASASGAPSTGGTSESATPESGPGSPAGSPTSTEEG
SPAGSPTSTEEGSTSSTAESPGPGSTSESPSGTAPGTSPSGESSTAPGTPGSGTASSS
PGSSTPSGATGSPGSSPSASTGTGPGSEPATSGSETPGTSESATPESGPGSEPATSG
SETPGSTSSTAESPGPGSTSSTAESPGPGTSPSGESSTAPGSEPATSGSETPGSEPAT
SGSETPGTSTEPSEGSAPGSTSSTAESPGPGTSTPESGSASPGSTSESPSGTAPGTST
EPSEGSAPGTSTEPSEGSAPGTSTEPSEGSAPGSSTPSGATGSPGSSPSASTGTGPG
ASPGTSSTGSPGSEPATSGSETPGTSESATPESGPGSPAGSPTSTEEGSSTPSGATG
SPGSSPSASTGTGPGASPGTSSTGSPGTSESATPESGPGTSTEPSEGSAPGTSTEPSE
GSAP |
| AM1318 | 79 | GTSTEPSEGSAPGSEPATSGSETPGSPAGSPTSTEEGSTSSTAESPGPGTSTPESGSA
SPGSTSESPSGTAPGSTSESPSGTAPGTSTPESGSASPGTSTPESGSASPGSEPATSG
SETPGTSESATPESGPGSPAGSPTSTEEGTSTEPSEGSAPGTSESATPESGPGTSTEP
SEGSAPGTSTEPSEGSAPGSPAGSPTSTEEGTSTEPSEGSAPGTSTEPSEGSAPGTS
ESATPESGPGTSESATPESGPGTSTEPSEGSAPGTSTEPSEGSAPGTSESATPESGP
GTSTEPSEGSAPGSEPATSGSETPGSPAGSPTSTEEGSSTPSGATGSPGTPGSGTAS
SSPGSSTPSGATGSPGTSTEPSEGSAPGTSTEPSEGSAPGSEPATSGSETPGSPAGSP
TSTEEGSPAGSPTSTEEGTSTEPSEGSAPGPEPTGPAPSGGSEPATSGSETPGTSES
ATPESGPGSPAGSPTSTEEGTSESATPESGPGSPAGSPTSTEEGSPAGSPTSTEEGT
SESATPESGPGSPAGSPTSTEEGSPAGSPTSTEEGSTSSTAESPGPGSTSESPSGTAP
GTSPSGESSTAPGSTSESPSGTAPGSTSESPSGTAPGTSPSGESSTAPGTSTEPSEGS
APGTSESATPESGPGTSESATPESGPGSEPATSGSETPGTSESATPESGPGTSESAT
PESGPGTSTEPSEGSAPGTSESATPESGPGTSTEPSEGSAPGTSPSGESSTAPGTSPS
GESSTAPGTSPSGESSTAPGTSTEPSEGSAPGSPAGSPTSTEEGTSTEPSEGSAPGS
PSASTGTGPGSSTPSGATGSPGSSTPSGATGSPGSSTPSGATGSPGSSTPSGATGSP
GASPGTSSTGSPGASASGAPSTGGTSPSGESSTAPGSTSSTAESPGPGTSPSGESST
APGTSESATPESGPGTSTEPSEGSAPGTSTEPSEGSAPGSSPSASTGTGPGSSTPSG
ATGSPGASPGTSSTGSPGTSTPESGSASPGTSPSGESSTAPGTSPSGESSTAPGTSES
ATPESGPGSEPATSGSETPGTSTEPSEGSAPGTSESPSGTAPGSTSESPSGTAPGTS
TPESGSASPGSPAGSPTSTEEGTSESATPESGPGTSTEPSEGSAPGSPAGSPTSTEEG
TSESATPESGPGSEPATSGSETPGSSTPSGATGSPGASPGTSSTGSPGSSTPSGATG
SPGSTSESPSGTAPGTSPSGESSTAPGSTSSTAESPGPGSSTPSGATGSPGASPGTSS
TGSPGTPGSGTASSSPGSPAGSPTSTEEGSPAGSPTSTEEGTSTEPSEGSAP |
| BC 864 | 80 | GTSTEPSEPGSAGTSTEPSEPGSAGSEPATSGTEPSGSGASEPTSTEPGSEPATSGT
EPSGSEPATSGTEPSGSEPATSGTEPSGSGASEPTSTEPGTSTEPSEPGSAGSEPATS
GTEPSGTSTEPSEPGSAGSEPATSGTEPSGSEPATSGTEPSTSTEPSEPGSAGTSTE
PSEPGSAGSEPATSGTEPSGSEPATSGTEPSGTSEPSTSEPGAGSGASEPTSTEPGTS
EPSTSEPGAGSEPATSGTEPSGSEPATSGTEPSGTSTEPSEPGSAGTSTEPSEPGSA
GSGASEPTSTEPGSEPATSGTEPSGSEPATSGTEPSGSEPATSGTEPSGSEPATSGT
EPSGTSTEPSEPGSAGSEPATSGTEPSGSGASEPTSTEPGTSTEPSEPGSAGSEPATS
GTEPSGSGASEPTSTEPGTSTEPSEPGSAGSGASEPTSTEPGSEPATSGTEPSGSGA
SEPTSTEPGSEPATSGTEPSGSGASEPTSTEPGTSTEPSEPGSAGSEPATSGTEPSGS
GASEPTSTEPGTSTEPSEPGSAGSEPATSGTEPSGTSTEPSEPGSAGSEPATSGTEPS
GTSTEPSEPGSAGTSTEPSEPGSAGTSTEPSEPGSAGTSTEPSEPGSAGTSTEPSEPG
SAGTSTEPSEPGSAGTSEPSTSEPGAGSGASEPTSTEPGTSTEPSEPGSAGTSTEPSE
PGSAGTSTEPSEPGSAGSEPATSGTEPSGSGASEPTSTEPGSEPATSGTEPSGSEPA
TSGTEPSGSEPATSGTEPSGSEPATSGTSEPSTSEPGAGSEPATSGTEPSGS
GASEPTSTEPGTSTEPSEPGSAGSEPATSGTEPSGSGASEPTSTEPGTSTEPSEPGSA |

TABLE 4-continued

XTEN Polypeptides

| XTEN Name | SEQ ID NO: | Amino Acid Sequence |
|---|---|---|
| BD864 | 81 | GSETATSGSETAGTSESATSESGAGSTAGSETSTEAGTSESATSESGAGSETATSG<br>SETAGSETATSGSETAGTSTEASEGSASGTSTEASEGSASGTSESATSESGAGSET<br>ATSGSETAGTSTEASEGSASGSTAGSETSTEAGTSESATSESGAGTSESATSESGA<br>GSETATSGSETAGTSESATSESGAGTSTEASEGSASGSETATSGSETAGSETATSG<br>SETAGTSTEASEGSASGSTAGSETSTEAGTSESATSESGAGTSTEASEGSASGSET<br>ATSGSETAGSTAGSETSTEAGTSAGSETSTEAGSETATSGSETAGTSESATSESGA<br>GTSESATSESGAGSETATSGSETAGTSESATSESGAGTSESATSESGAGSETATSG<br>SETAGSETATSGSETAGTSTEASEGSASGSTAGSETSTEAGSETATSGSETAGTSE<br>SATSESGAGSTAGSETSTEAGSTAGSETSTEAGSTAGSETSTEAGTSTEASEGSAS<br>GSTAGSETSTEAGSTAGSETSTEAGTSTEASEGSASGSTAGSETSTEAGSETATSG<br>SETAGTSTEASEGSASGTSESATSESGAGSETATSGSETAGTSESATSESGAGTSE<br>SATSESGAGSETATSGSETAGTSESATSESGAGSETATSGSETAGTSTEASEGSAS<br>GTSTEASEGSASGSTAGSETSTEAGSTAGSETSTEAGSETATSGSETAGTSESATS<br>ESGAGTSESATSESGAGSETATSGSETAGSETATSGSETAGSETATSGSETAGTST<br>EASEGSASGTSESATSESGAGSETATSGSETAGSETATSGSETAGTSESATSESGA<br>GTSESATSESGAGSETATSGSETA |
| Y288 | 82 | GEGSGEGSEGEGSEGSGEGEGGSEGSGEGEGGSEGSEGEGGSEGSEGEGGSEGSEG<br>EGSGEGSEGEGGSEGSEGEGSGEGSEGEGSEGGSEGEGGSEGSEGEGSGEGSEGE<br>GGEGGSEGEGSEGSGEGEGSGEGSEGEGSGEGSEGEGSGEGSEGEGSEGSGEGE<br>GSEGSGEGEGGSEGSEGEGSEGSGEGEGGSEGSGEGEGSGEGSEGEGGGEGSEGE<br>GSGEGGEGEGSEGGSEGEGGSEGGEGEGSEGSGEGEGSEGGSEGEGSEGGSEGE<br>GSEGSGEGEGSEGSGE |
| Y576 | 83 | GEGSGEGSEGEGSEGSGEGEGSEGSGEGEGGSEGSEGEGSEGSGEGEGGEGSGE<br>GEGSGEGSEGEGGGEGSEGEGSGEGGEGEGSEGGSEGEGGSEGGEGEGSGEGSGE<br>GEGSEGGSEGEGSEGGSEGEGSEGSGEGEGSEGSGEGEGSEGSGEGEGSEGSGEG<br>EGSEGGSEGEGGSEGSEGEGSGEGSEGEGSEGSEGEGGGSEGSEGEGSGEGSEG<br>EGGSEGSEGEGEGSEGEGEGGEGSGEGEGSEGSGEGSGEGSEGEGSEGSGEG<br>EGSEGSGEGEGGSEGSEGEGSGEGSEGEGSEGSGEGEGSEGSGEGEGGSEGSEGE<br>GGSEGSEGEGGSEGSEGEGGEGSGEGEGSEGSGEGEGSGEGSEGEGSEGSGEGE<br>GSEGSGEGEGGSEGSEGEGSEGSGEGEGGEGSGEGEGSGEGSEGEGGGEGSEGE<br>GSEGSGEGEGSEGSGEGEGSGEGSEGEGSGEGSEGEGSEGGSEGEGSEGGSEGEG<br>SEGSGEGEGSEGSGEGEGSGEGSEGEGGSEGGEGEGSEGGSEGEGSEGGSEGEG<br>GEGSGEGEGGGEGSEGEGSEGSGEGEGSGEGSE |

4. XTEN Segments

In one embodiment, the invention provides an isolated CFXTEN fusion protein wherein the cumulative length of the XTEN component is greater than about 100 to about 3000 amino acid residues containing at least one polypeptide sequence segment selected from Tables 4, 9, 10, 11, 12, and 13 and wherein at least about 90%, or at least about 91%, or at least about 92%, or at least about 93%, or at least about 94%, or at least about 95%, or at least about 96%, or at least about 97%, or at least about 98% or more of the remainder of the XTEN sequence contains hydrophilic amino acids and less than about 2% of the remainder of the XTEN consists of hydrophobic or aromatic amino acids or cysteine. In some embodiments, the XTEN contains multiple segments wherein the segments are identical or different. In another embodiment, the invention provides an isolated CFXTEN fusion protein wherein the cumulative length of the XTEN component is greater than about 100 to about 3000 amino acid residues and comprises at least one sequence segment of at least about 100 to about 923, or at least about 100 to about 875, or at least about 100 to about 576, or at least about 100 to about 288, or at least about 100 to about 144 amino acid residues wherein the sequence segment(s) consists of at least three different types of amino acids and the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic or aromatic amino acids, or cysteine. In another embodiment, the invention provides an isolated CFXTEN fusion protein wherein the cumulative length of the XTEN component is greater than about 100 to about 3000 amino acid residues and comprises at least one sequence segment of at least about 200 to about 923, or at least about 200 to about 875, or at least about 200 to about 576, or at least about 200 to about 288 amino acid residues wherein the sequence segment(s) the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and wherein the subsequence score of the segment is less than 12, more preferably less than 10, more preferably less than 9, more preferably less than 8, more preferably less than 7, more preferably less than 6, and most preferably less than 5, and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic, aromatic or cysteine amino acids.

5. N-Terminal XTEN Expression-Enhancing Sequences

In some embodiments, the invention provides a short-length XTEN sequence incorporated as the N-terminal portion of the CFXTEN fusion protein. It has been discovered that the expression of the fusion protein is enhanced in a host cell transformed with a suitable expression vector comprising an optimized N-terminal leader polynucleotide sequence (that encodes the N-terminal XTEN) incorporated into the polynucleotide encoding the binding fusion protein. As described in Examples 14-17, a host cell transformed with such an expression vector comprising an optimized N-terminal leader sequence (NTS) in the binding fusion protein gene results in greatly-enhanced expression of the fusion protein compared to the expression of a corresponding fusion protein from a polynucleotide not comprising the NTS, and obviates the need for incorporation of a non-XTEN leader sequence used to enhance expression. In one embodiment, the invention provides CFXTEN fusion proteins comprising an NTS wherein the expression of the binding fusion protein from the encoding gene in a host cell is enhanced about 50%, or about 75%, or about 100%, or about 150%, or about 200%, or about 400% compared to expression of a CFXTEN fusion protein not comprising the N-terminal XTEN sequence (where the encoding gene lacks the NTS).

In one embodiment, the N-terminal XTEN polypeptide of the CFXTEN comprises a sequence that exhibits at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, more preferably at least 99%, or exhibits 100% sequence identity compared to the amino acid sequence of AE48 or AM48, the respective amino acid sequences of which are as follows:

```
                                        (SEQ ID NO: 61)
AE48: MAEPAGSPTSTEEGTPGSGTASSSPGSSTPSGATGSPGASPG

TSSTGS (SEQ ID NO: 62)
AM48: MAEPAGSPTSTEEGASPGTSSTGSPGSSTPSGATGSPGSSTP

SGATGS
```

In another embodiment, the short-length N-terminal XTEN is linked to an XTEN of longer length to form the N-terminal region of the CFXTEN fusion protein, wherein the polynucleotide sequence encoding the short-length N-terminal XTEN confers the property of enhanced expression in the host cell, and wherein the long length of the expressed XTEN contributes to the enhanced properties of the XTEN carrier in the fusion protein, as described above. In the foregoing, the short-length XTEN is linked to any of the XTEN disclosed herein (e.g., an XTEN of Table 3) and the resulting XTEN, in turn, is linked to the N-terminal of any of the CF disclosed herein (e.g., a CF of Table 1 or Table 2) as a component of the fusion protein. Alternatively, polynucleotides encoding the short-length XTEN (or its complement) is linked to polynucleotides encoding any of the XTEN (or its complement) disclosed herein and the resulting gene encoding the N-terminal XTEN, in turn, is linked to the 5' end of polynucleotides encoding any of the CF (or to the 3' end of its complement) disclosed herein. In some embodiments, the N-terminal XTEN polypeptide with long length exhibits at least about 80%, or at least about 90%, or at least about 91%, or at least about 92%, or at least about 93%, or at least about 94%, or at least about 95%, or at least about 96%, or at least about 97%, or at least about 98%, or at least 99%, or exhibits 100% sequence identity compared to an amino acid sequence selected from the group consisting of the sequences AE624, AE912, and AM923.

In any of the foregoing N-terminal XTEN embodiments described above, the N-terminal XTEN can have from about one to about six additional amino acid residues, preferably selected from GESTPA, to accommodate the restriction endonuclease restriction sites that is employed to join the nucleotides encoding the N-terminal XTEN to the gene encoding the targeting moiety of the fusion protein. The methods for the generation of the N-terminal sequences and incorporation into the fusion proteins of the invention are described more fully in the Examples.

6. Net Charge

In other embodiments, the XTEN polypeptides have an unstructured characteristic imparted by incorporation of amino acid residues with a net charge and/or reducing the proportion of hydrophobic amino acids in the XTEN sequence. The overall net charge and net charge density is controlled by modifying the content of charged amino acids in the XTEN sequences. In some embodiments, the net charge density of the XTEN of the compositions may be above +0.1 or below −0.1 charges/residue. By "net charge density" of a protein or peptide herein is meant the net charge divided by the total number of amino acids in the protein or proptide. In other embodiments, the net charge density of a XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, in some embodiments, the XTEN sequences are designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. In preferred embodiments, the negative charge is conferred by incorporation of glutamic acid residues. Accordingly, in one embodiment the invention provides XTEN in which the XTEN sequences contain about 8, 10, 15, 20, 25, or even about 30% glutamic acid. Generally, the glutamic residues is spaced uniformly across the XTEN sequence. In some cases, the XTEN can contain about 10-80, or about 15-60, or about 20-50 glutamic residues per 20 kDa of XTEN that can result in an XTEN with charged residues that would have very similar pKa, which can increase the charge homogeneity of the product and sharpen its isoelectric point, enhance the physicochemical properties of the resulting CFXTEN fusion protein for, and hence, simplifying purification procedures.

The XTEN of the compositions of the present invention generally have no or a low content of positively charged amino acids. In some embodiments, the XTEN may have less than about 10% amino acid residues with a positive charge, or less than about 7%, or less than about 5%, or less than about 2%, or less than about 1% amino acid residues with a positive charge. However, the invention contemplates constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins are constructed that comprises XTEN, a coagulation factor, plus a chemotherapeutic agent useful in the treatment of growth-related diseases or disorders, wherein the maximum number of molecules of the agent incorporated into the XTEN component is determined by the numbers of lysines or other amino acids with reactive side chains (e.g., cysteine) incorporated into the XTEN.

In some embodiments, the XTEN sequence comprises charged residues separated by other residues such as serine or glycine, which leads to better expression or purification behavior. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5. In these embodiments, the XTEN incorporated into the CFXTEN fusion protein compositions of the present invention carry a net negative charge under physiologic conditions that contribute to the unstructured conformation and reduced binding of the XTEN component to mammalian proteins and tissues.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a CFXTEN fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

7. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides CFXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity can attribute to, at least in part, a result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and also reduce the immunogenicity of the CF fusion partner in the CFXTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281: 95-108). Of particular interest are peptide sequences that can be oligomerized without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 45. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that serve as anchor residues during peptide display on MHC, such as M, I, L, V, F. In some embodiments, an XTEN component incorporated into a CFXTEN does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In another embodiment, the inventive XTEN sequences, including those incorporated into the subject CFXTEN fusion proteins, are rendered substantially non-immunogenic by the restriction of known proteolytic sites from the sequence of the XTEN, reducing the processing of XTEN into small peptides that can bind to MHC II receptors. In another embodiment, the XTEN sequence is rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN render the XTEN compositions, including the XTEN of the CFXTEN fusion protein compositions, substantially unable to be bound by mammalian receptors, including those of the immune system. In one embodiment, an XTEN of a CFXTEN fusion protein can have >100 nM $K_d$ binding to a mammalian receptor, or greater than 500 nM $K_d$, or greater than 1 µM $K_d$ towards a mammalian cell surface or circulating polypeptide receptor.

Additionally, the non-repetitive sequence and corresponding lack of epitopes of XTEN limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while a XTEN can make contacts with many different B cells over its extended sequence, each individual B cell may only make one or a small number of contacts with an individual XTEN due to the lack of repetitiveness of the sequence. Not being to be bound by any theory, XTENs typically have a much lower tendency to stimulate proliferation of B cells and thus an immune response. In one embodiment, the CFXTEN have reduced immunogenicity as compared to the corresponding CF that is not fused to an XTENT. In one embodiment, the administration of up to three parenteral doses of a CFXTEN to a mammal result in detectable anti-CFXTEN IgG at a serum dilution of 1:100 but not at a dilution of 1:1000. In another embodiment, the administration of up to three parenteral doses of a CFXTEN to a mammal result in detectable anti-CF IgG at a serum dilution of 1:100 but not at a dilution of 1:1000. In another embodiment, the administration of up to three parenteral doses of a CFXTEN to a mammal result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness is non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the CFXTEN compositions can remain in circulation for an increased period of time.

8. Increased Hydrodynamic Radius

In another aspect, the present invention provides XTEN in which the XTEN polypeptides have a high hydrodynamic radius that confers a corresponding increased apparent molecular weight to the CFXTEN fusion protein incorporating the XTEN. As detailed in Example 38, the linking of XTEN to CF sequences, such as FIX or FVII sequences, results in CFXTEN compositions that can have increased hydrodynamic radii, increased apparent molecular weight, and increased apparent molecular weight factor compared to a CF not linked to an XTEN. For example, in therapeutic applications in which prolonged half-life is desired, compositions in which a XTEN with a high hydrodynamic radius is incorporated into a fusion protein comprising CF can effectively enlarge the hydrodynamic radius of the composition beyond the glomerular pore size of approximately 3-5 nm (corresponding to an apparent molecular weight of about 70 kDA, which is larger than both native FIX and FVII) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins. The hydrodynamic radius of a protein is determined by its molecular weight as well as by its structure, including shape or compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. As the results of Example 38 demonstrate, the addition of increasing lengths of XTEN results in proportional increases in the parameters of hydrodynamic radius, apparent molecular weight, and apparent molecular weight factor, permitting the tailoring of CFXTEN to desired characteristic cut-off apparent molecular weights or hydrodynamic radii. Accordingly, in certain embodiments, the CFXTEN fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in an CFXTEN fusion protein can lead to reduced renal clearance of the resulting fusion protein, leading to a corresponding increase in terminal half-life, an increase in mean residence time, and/or a decrease in renal clearance rate.

In another embodiment, an XTEN of a chosen length and sequence (e.g., a sequence from Table 4 or a sequence variant thereof) can be selectively incorporated into a CFXTEN to create a fusion protein that have, under physiologic conditions, an apparent molecular weight of at least about 500 kDa, or at least about 800 kDa, or at least about 1000 kDa, or at least about 1500 kDA, or at least about 1800 kDa, or at least about 2000 kDa, or at least about 2300 kDa or more. In another embodiment, an XTEN of a chosen length and sequence can be selectively linked to a CF to result in a CFXTEN fusion protein that has, under physiologic conditions, an apparent molecular weight factor of at least four, alternatively of at least five, alternatively of at least six, alternatively of at least eight, alternatively of at least 10, alternatively of at least 15, or an apparent molecular weight factor of at least 20 or greater. In another embodiment, the CFXTEN fusion protein has, under physiologic conditions, an apparent molecular weight factor that is about 4 to about 20, or is about 6 to about 15, or is about 8 to about 12, or is about 9 to about 10 relative to the actual molecular weight of the fusion protein.

V). CFXTEN Variant, Structural Configurations and Properties

The CF of the subject compositions are not limited to native, full-length FIX or FVII polypeptides, but also include recombinant versions as well as biologically and/or pharmacologically active forms with sequence variants, combinations of FVII and FIX sequences, or fragments thereof. For example, it will be appreciated that various amino acid deletions, insertions and substitutions can be made in the CF to create variants without departing from the spirit of the invention with respect to the biological activity or pharmacologic properties of the CF. Examples of conservative substitutions for amino acids in polypeptide sequences are shown in Table 5. However, in embodiments of the CFXTEN in which the sequence identity of the CF is less than 100% compared to a specific sequence disclosed herein, the invention contemplates substitution of any of the other 19 natural L-amino acids for a given amino acid residue of the given CF (e.g., FIX or FVII), which may be at any position within the sequence of the CF, including adjacent amino acid residues. If any one substitution results in an undesirable change in biological activity, then one of the alternative amino acids can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known in the art. In addition, variants can include, for instance, polypeptides wherein one or more amino acid residues are added or deleted at the N- or C-terminus of the full-length native amino acid sequence of a CF that retains some if not all of the biological activity of the native peptide; e.g., the ability to activate another coagulation factor and/or participate in the coagulation cascade, leading to fibrin formation and hemostasis.

In one embodiment, a factor IX incorporated into a CFXTEN fusion protein has a sequence that exhibits at least about 80% sequence identity compared to a sequence from Table 1, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, sequence identity as compared with a sequence from Table 1.

In one embodiment, a factor VII incorporated into a CFXTEN fusion protein has a sequence that exhibits at least about 80% sequence identity compared to a sequence from Table 2, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, sequence identity as compared with a sequence from Table 2.

TABLE 5

Exemplary conservative amino acid substitutions

| Original Residue | Exemplary Substitutions |
|---|---|
| Ala (A) | val; leu; ile |
| Arg (R) | lys; gln; asn |
| Asn (N) | gln; his; lys; arg |
| Asp (D) | Glu |
| Cys (C) | Ser |
| Gln (Q) | Asn |
| Glu (E) | Asp |
| Gly (G) | Pro |
| His (H) | asn: gln: lys: arg |
| xIle (I) | leu; val; met; ala; phe: norleucine |
| Leu (L) | norleucine: ile: val; met; ala: phe |
| Lys (K) | arg: gln: asn |
| Met (M) | leu; phe; ile |
| Phe (F) | leu: val: ile; ala |
| Pro (P) | Gly |
| Ser (S) | Thr |
| Thr (T) | Ser |
| Trp (W) | Tyr |
| Tyr (Y) | Trp: phe: thr: ser |
| Val (V) | Ile; leu; met; phe; ala; norleucine |

1. Internal XTEN Sequences

The present invention encompasses CFXTEN that comprise one or more XTEN sequences located internal to the CF sequence. The one or more internally-located XTEN can be a sequence length of 36 to ≥1000 amino acid residues. In some embodiments, the CFXTEN can have one or two or three or four or more XTEN sequences with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to one or more XTEN selected from Tables 4, 9, 10, 11, 12 and 13 wherein the XTEN sequences are located internal to the CF sequence. In one embodiment of the foregoing, the CFXTEN with one or more internal XTEN has an additional XTEN located at the N- or C-terminus of the fusion protein with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100%, sequence identity compared to one or more XTEN selected from Table 4. In another embodiment, the invention provided CFXTEN with internal XTEN (as detailed below) that further comprises a C-terminus XTEN linked to the CF by a cleavage sequence (e.g., a cleavage sequence of Table 7) such that the XTEN can be released when acted on by a protease. The linkage of XTEN by cleavage sequences is more fully described below and in the Examples.

Figure 2:
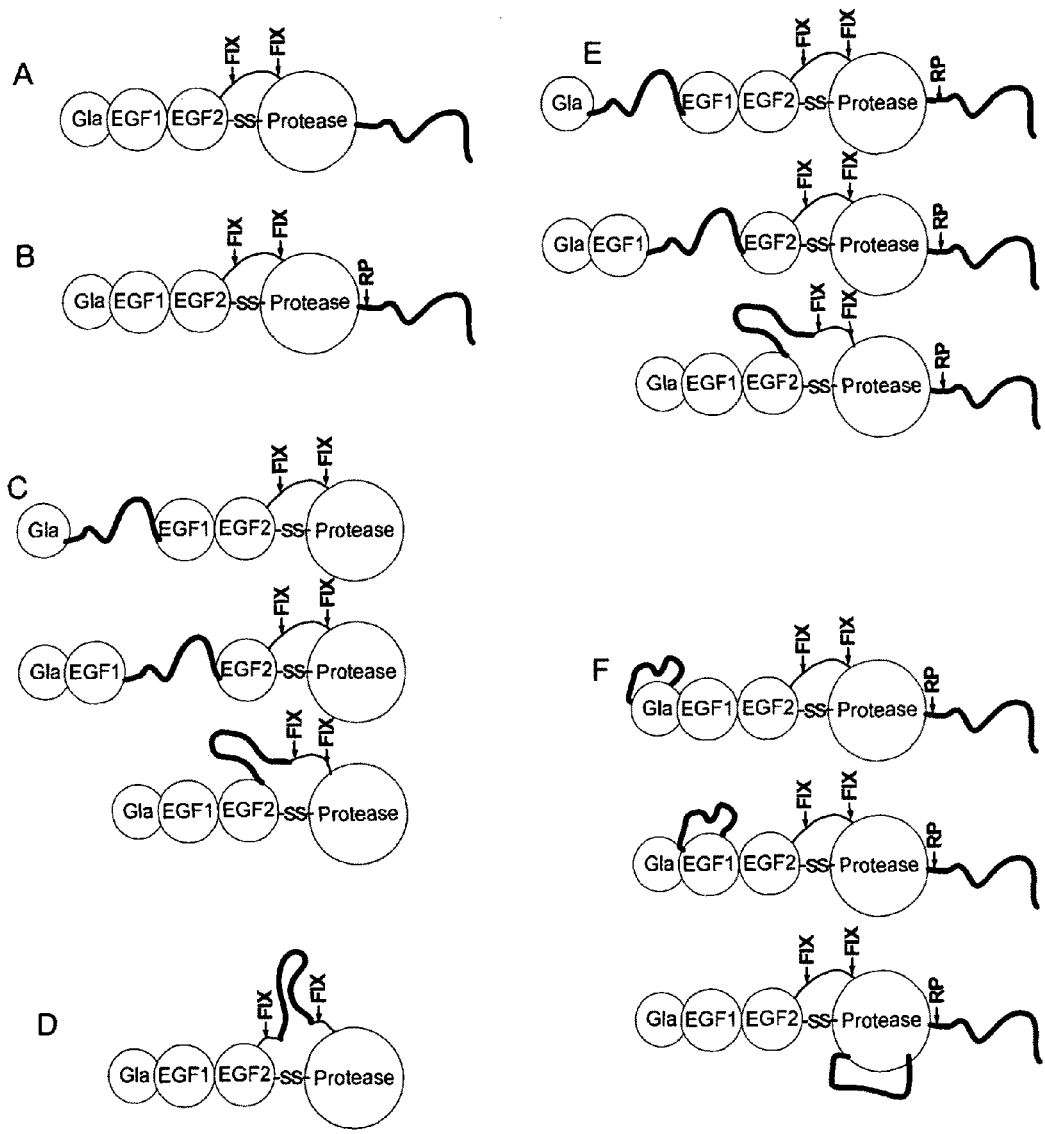
FIG. 2 illustrates several examples of CXTEN configurations of FIX-XTEN and associated protease cleavage sites.

In some embodiments, as illustrated in FIG. 2 and described more fully in the Examples, an XTEN can be located between the domains of a FIX sequence; e.g., between the Gla and EGF1, or between the EGF1 and EGF2, or between the EGF2 and the activation peptide, or within the sequence of the activation peptide between the R145-A146 and R180-V181 activation peptide residues of the AP (i.e., between any two amino acids of the sequence TVFPDVDYVNSTEAETILDNITQSTQSFNDF (SEQ ID NO: 84)), or between the EGF2 and the activation peptide, or between the activation peptide and the protease domain, or any combination of the foregoing. In other embodiments, as illustrated in FIG. 2 and detailed more fully in the Examples, the XTEN can be inserted within an existing loop sequence within an individual domain of the FIX sequence so that 1) the XTEN forms a looped structure outside the domain and doesn't disrupt the normal architecture of the domain; and 2) the XTEN can be released by cleavage of incorporated cleavage sites.

Figure 5:
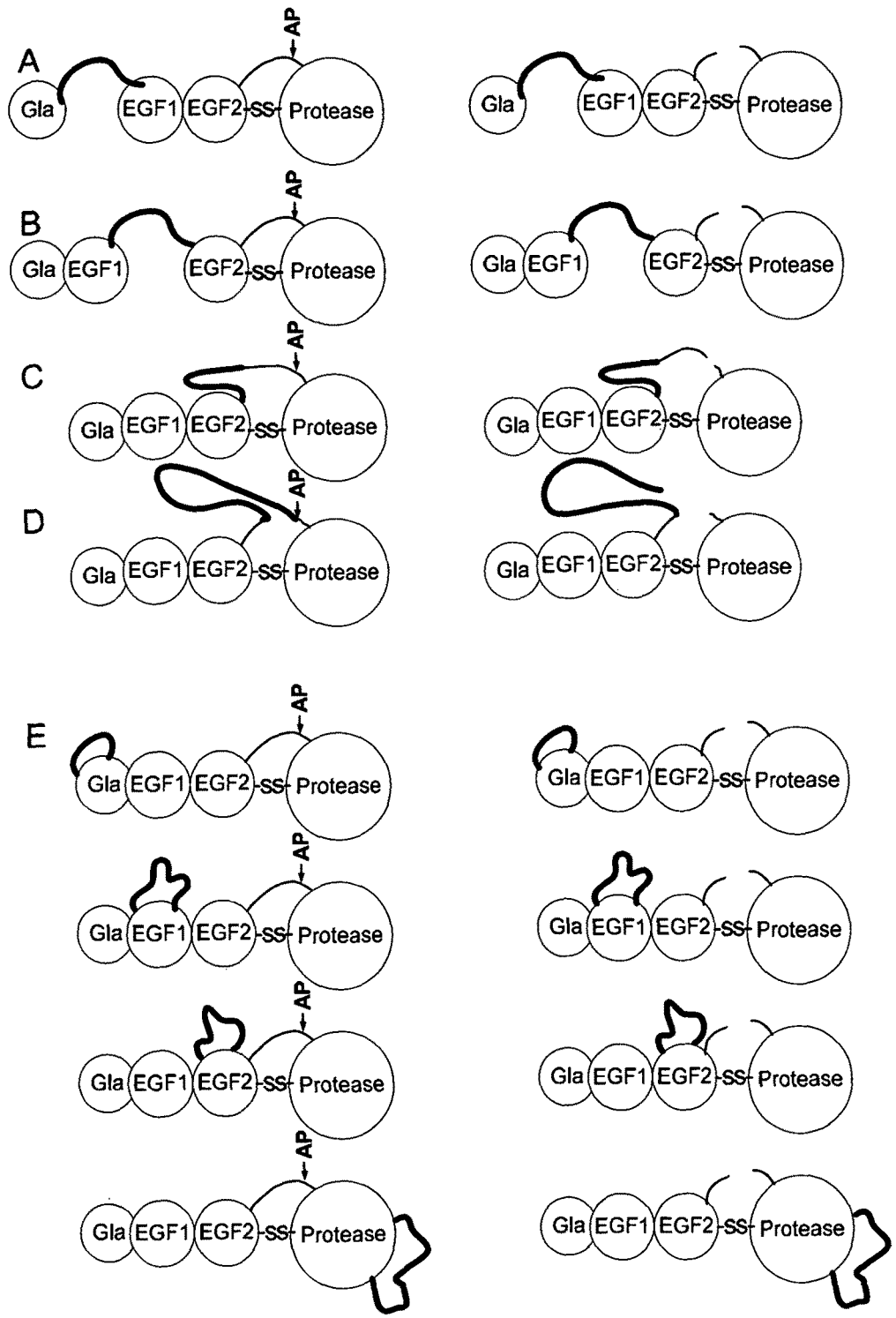
FIG. 5 illustrates a strategy for FVII-XTEN design approach using internal XTEN.
Figure 6:
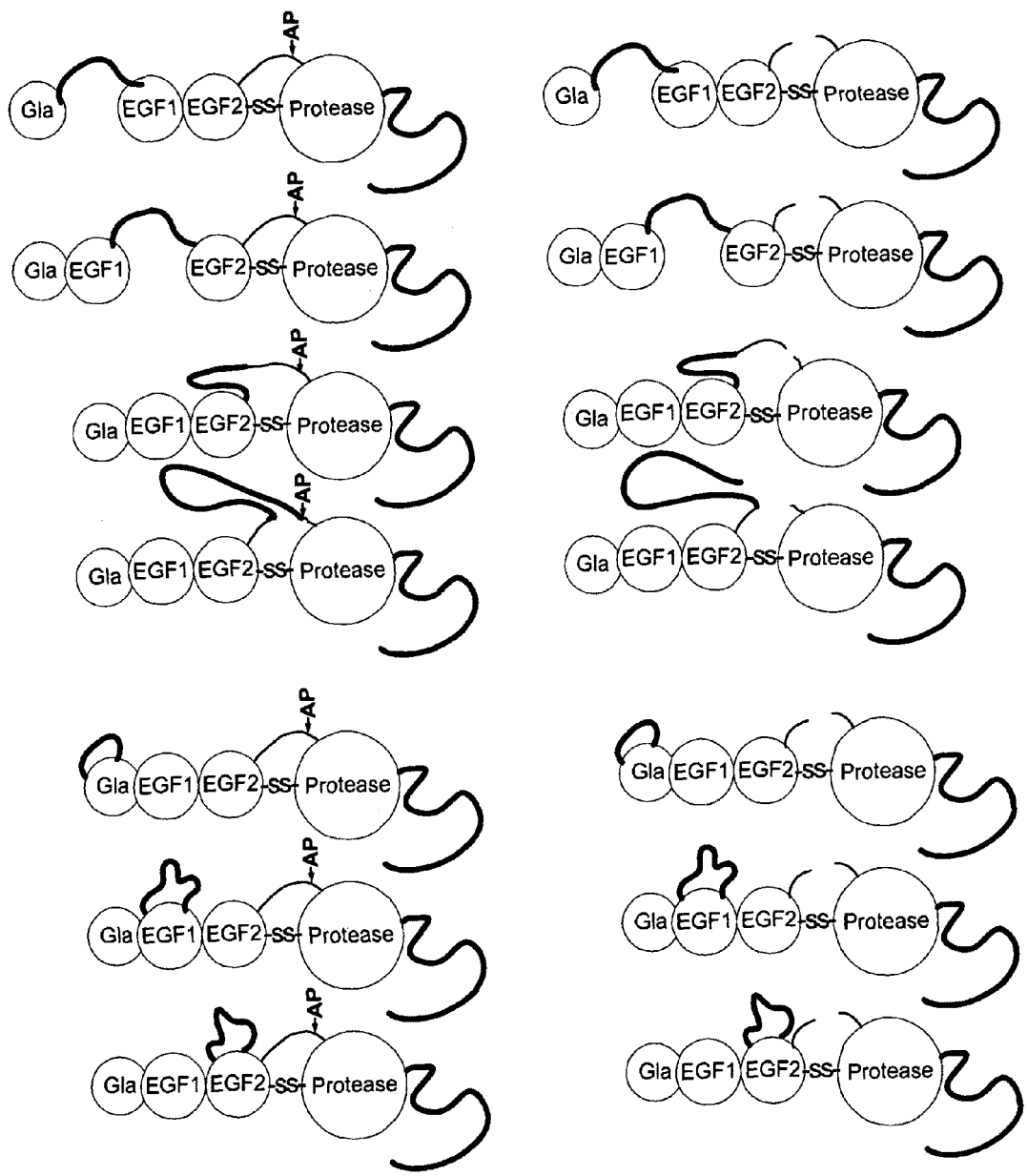
FIG. 6 illustrates essentially the same constructs as FIG. 5, but with an XTEN linked at the C-terminus of each construct.
Figure 7:
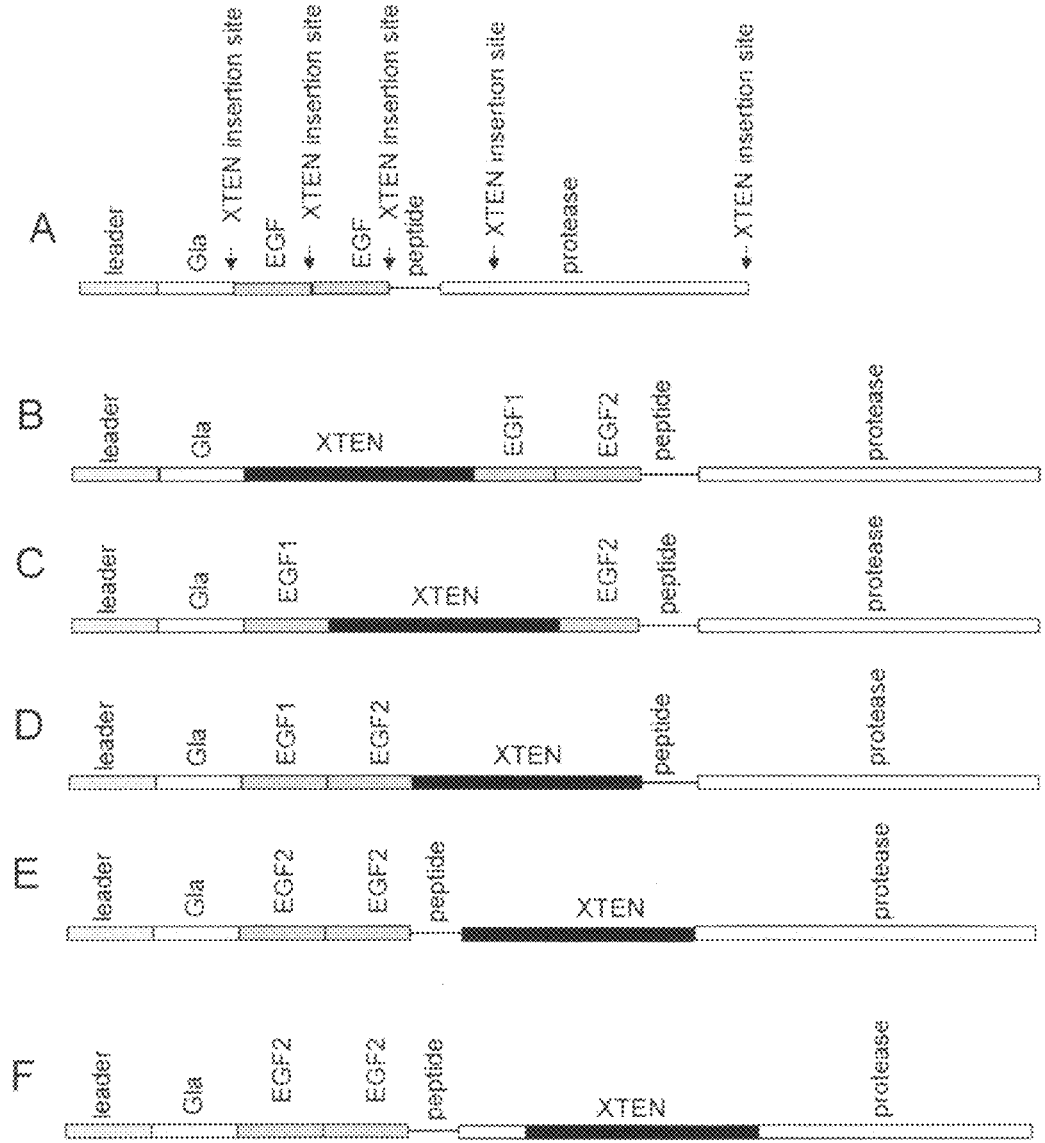
FIG. 7A is a schematic that shows some of the various locations in which XTEN can be inserted internal to the sequences of the coagulation factors FVII or FIX.
FIG. 7B shows an XTEN insertion between Gla and EGF1.
FIG. 7C shows an XTEN insertion between EGF1 and EGF2.
FIG. 7D shows an XTEN insertion between EGF2 and the activation peptide.
FIG. 7E shows an XTEN insertion between the activation peptide and the protease domain.
FIG. 7F shows an XTEN insertion within the protease domain.
Figure 8:
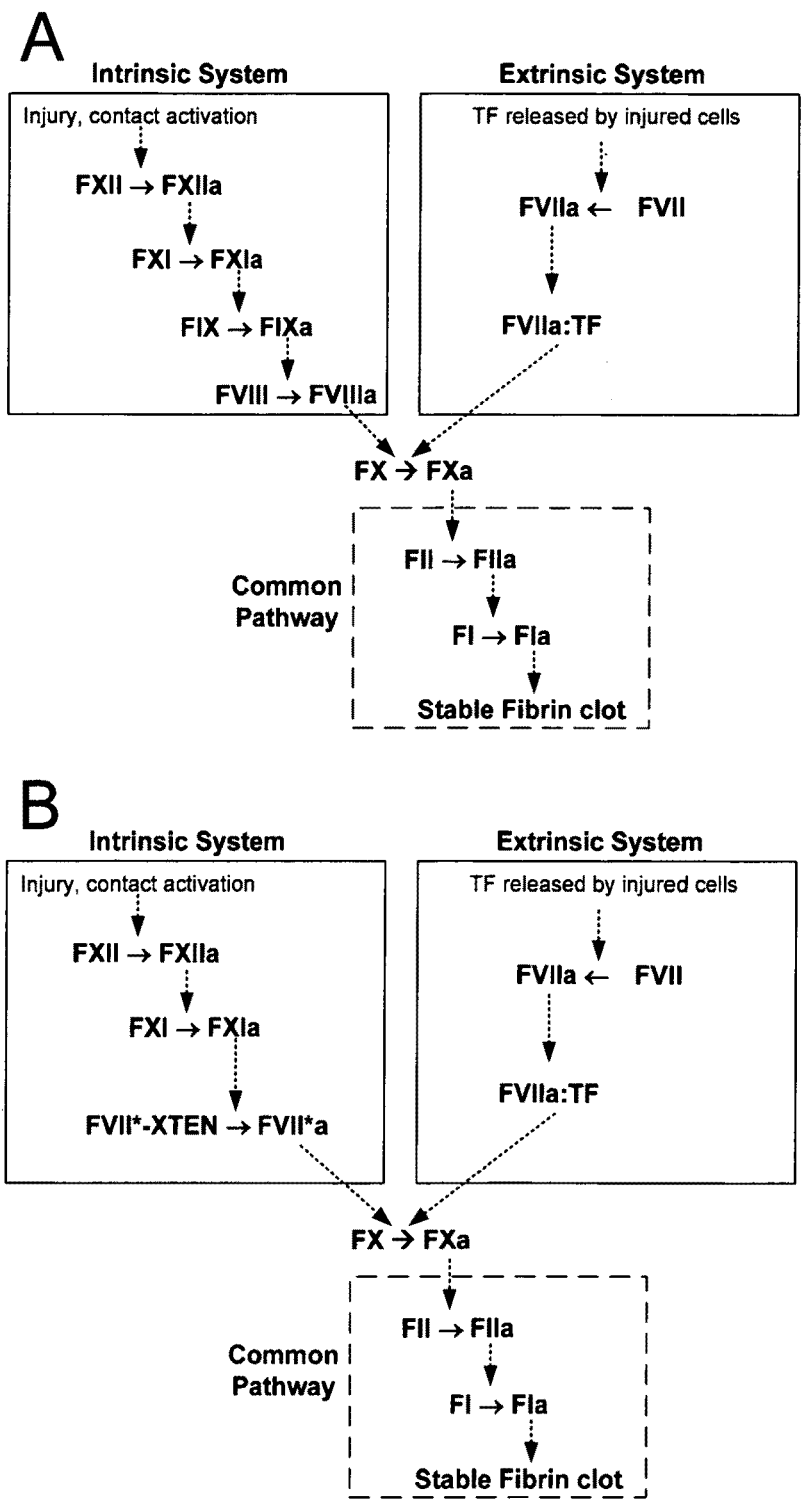
FIG. 8 is a schematic of the key components of the clotting system.

In another embodiment, the invention provides a CFXTEN comprising a FVII that incorporates one or more XTEN located between the domains of a FVII sequence; e.g., between the Gla and EGF1, or between the EGF1 and EGF2, or between the EGF2 and the activating peptide, or between the activating peptide and the protease domain, or any combination of the foregoing. The XTEN can be a sequence of 36 to ≥1000 amino acid residues including, but not limited to a sequence that has at least about 80%, or at least about 85%, or at least about 90%, or at least about 95% or more sequence identity compared to a sequence from Table 4, 8, 9, 10, 11, 12, and 13. In one embodiment, as illustrated in FIGS. 5 and 6, an XTEN is incorporated between the EGF2 domain and the single lytic cleavage site at residues $Arg^{152}$-$Ile^{153}$. In other embodiments, as illustrated in FIGS. 5 and 6 and detailed more fully in the Examples, the XTEN can be inserted within an existing loop sequence within an individual domain of the FVII sequence so that 1) the XTEN forms a looped structure outside the domain and doesn't disrupt the normal architecture of the domain; and 2) the XTEN can be released by cleavage of incorporated cleavage sites.

2. Factor VII-FIX Hybrid Sequence Variants

The invention provides an isolated factor VII polypeptide comprising at least one heterologous sequence that is cleavable by a pro-coagulant protease that does not activate a wildtype factor VII, wherein upon cleavage heterologous sequence, the factor VII polypeptide is activated. For example, CFXTEN with factor VII-factor IX hybrid sequence variants that incorporate into, or replace a portion of the sequence, a factor VII construct portions of the activating peptide domain (AP) sequence from factor IX, resulting in hybrid compositions that can be activated as part of the intrinsic system of the coagulation cascade. The CFXTEN that incorporate such factor VII-factor IX sequence variants as the CF component of the fusion protein permit administration to a subject a composition in which the CF component is not activated, and can be dosed at high amounts because it remains as an inert, circulating depot that is largely resistant to inactivation by protease inhibitors until activated by the triggering of the intrinsic coagulation cascade or by autoactivation, the latter a slow process. Non-limiting examples of FVII/FIX hybrid sequences are illustrated in FIG. 36, showing those portions of the hybrid amino acid sequences that have homology with those of native FIX and FVII. In some embodiments, the CFXTEN comprise factor VII-factor IX sequence variants that substitute portions or the entirety of the FIX activating peptide sequence with one or both FIX AP cleavage sites for FVII sequence to the N-terminal side of the protease domain of FVII; i.e., either towards the N-terminus beginning with the arginine at position 212 of the full-length precursor polypeptide or the isoleucine at position 213. In one embodiment, the factor VII-factor IX sequence CF incorporates the full-length FIX AP domain plus at least about 2, or at least about 3, or at least about 4, or at least about 5, or at least about 6, or at least about 7, or at least about 8, or at least about 9, or at least about 10, or at least about 11, or at least about 12 amino acids flanking adjacent amino acid residues on one or both sides of the R145-A146 and R180-V181 cleavage sites of FIX (e.g., the sequence RVSVSQTSKLTRAETVFPD-VDYVNSTEAETILDNITQSTQSFNDFTRVVGGE (SEQ ID NO: 1) in the case of 12 flanking amino acids on the N-terminus side and 5 flanking amino acids on the C-terminus side). In another embodiment, the CFXTEN comprises a factor VII-factor IX sequence variant that incorporates a portion of the AP that includes a sequence of at least about 2, or at least about 3, or at least about 4, or at least about 5 that flank the R145-A146 AP cleavage site (e.g., the sequence TSKL-TRAETVFP (SEQ ID NO: 3) in the case of 6 flanking amino acids on either side of the cleavage site). In another embodiment, the CFXTEN comprises a factor VII-factor IX sequence variant that incorporates a portion of the AP that includes a sequence of at least about 2, or at least about 3, or at least about 4, or at least about 5 amino acids that flank one or both sides of the R180-V181 AP cleavage site (e.g., the sequence and DFTRV (SEQ ID NO: 4) in the case of 4 amino acids on the N-terminal flank and valine as the C-terminus of the cleavage site from FIX). In another embodiment, the CFXTEN comprises the factor VII-factor IX sequence variant of any of the foregoing embodiments of this paragraph that further includes the same AP sequence as a linker between the C-terminus of the FVII component and the XTEN component of the fusion protein; e.g., an N- to C-terminus configuration of FVII variant-AP sequence-XTEN, thereby permitting the release of the factor VII-factor IX sequence variant component from the CFXTEN fusion protein by the same intrinsic coagulation factor as per that of the FVII to FVIIa transition. In another embodiment, the CFXTEN comprises the factor VII-factor IX sequence variant of any of the foregoing embodiments of this paragraph that further includes the factor XI cleavage sequence KLTRAET (SEQ ID NO: 6) as the linker between the FVII variant sequence and the XTEN, thereby permitting the release of the factor VII-factor IX sequence variant component from the CFXTEN fusion protein by the initiation of the intrinsic coagulation cascade. It is expected d that with the release of the XTEN from the factor VII-factor IX sequence variant, the activated factor VII-factor IX sequence variant would have a shorter half-life compared to the intact CFXTEN, thereby increasing the margin of safety and tolerability of the composition in a subject. In the embodiments of the paragraph, the activated factor VII-factor IX sequence variant molecule can have at least about 60%, or at least about 70%, or at least about 80%, or at least about 90%, or at least about 95% of the biological activity as native FVIIa, as measured by any of the appropriate assays or parameters disclosed herein (e.g., PT or bleeding time assays).

In yet another embodiment, the invention provides the factor VII-factor IX sequence variants of the foregoing embodiments of this paragraph without a linked XTEN, permitting their administration to a subject as a circulating depot of the factor VII-factor IX hybrid that can be activated by either the intrinsic or extrinsic coagulation cascade. In one embodiment, the invention provides a CFXTEN with a factor VII-factor IX sequence variant with incorporated FIX-derived sequence with an overall sequence that exhibits at least about 80% sequence identity, or at least about 85%, or at least about 90%, or at least about 95%, or at least about 96%, or at least about 97%, or at least about 98%, or at least about 99%, sequence identity compared to a sequence from Table 43. In another embodiment, the invention provides a factor VII-factor IX sequence variant with incorporated FIX-derived cleavage sequence (without an XTEN) with a sequence that exhibits at least about 80% sequence identity, or at least about 85%, or at least about 90%, or at least about 95%, or at least about 96%, or at least about 97%, or at least about 98%, or at least about 99%, sequence identity as compared with a sequence from Table 43 without an XTEN.

The CFXTEN comprising factor VII-factor IX sequence variants can be evaluated for biological activity using assays or in vivo parameters as described herein (e.g., in vitro coagulation assays or a pharmacodynamic effect in a hemophilia model), and those sequences that retain at least about 40%, or about 50%, or about 55%, or about 60%, or about 70%, or about 80%, or about 90%, or about 95% or more activity compared to the corresponding native FVII sequence is considered suitable for inclusion in the subject CFXTEN. The CF found to retain a suitable level of activity can be linked to one or more XTEN polypeptides described hereinabove. In one embodiment, a CF found to retain a suitable level of activity can be linked to one or more XTEN polypeptides having at least about 80% sequence identity to a sequence from Table 4, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence idendity as compared with a sequence of Table 4, resulting in a chimeric fusion protein.

3. CFXTEN Fusion Protein Configurations

The invention provides CFXTEN fusion protein compositions with the CF and XTEN components linked in specific N- to C-terminus configurations. In some embodiments, one or more CFs are linked to one or more XTENs, either at the N-terminus or at the C-terminus, with or without a spacer, to form a block copolymer, and the sequential arrangement of the CFs and the XTENs in the CFXTEN fusion protein are the same as the configuration known in the block copolymer chemistry. When there is more than one CF, XTEN, or spacer, each of the CF, the XTEN, or the spacer have the same or different sequences, and the CFs and/or XTENs are linked either continuously or alternately (regular or irregular). Thus, in all of the formulae provided herein, when there is more than one CF, XTEN, or spacer, each of the CF, XTEN, and spacer are the same or different. In some embodiments, the CFXTEN is a monomeric fusion protein with a CF linked to one XTEN polypeptide. In other embodiments, the CFXTEN is a monomeric fusion protein with a CF linked to two or more XTEN polypeptides. In still other embodiments, the CFXTEN is a monomeric fusion protein with two or more CF linked to one XTEN polypeptide. In still other embodiments, the CFXTEN is a monomeric fusion protein with two or more CF linked to two or more XTEN polypeptide. In still other embodiment, the CFXTEN is a monomeric fusion protein with a single CF in which XTEN is located within the CF sequence (e.g., within a FIX sequence such as between one or more domains as illustrated in FIGS. 2 and 5). Table 6 provides non-limiting examples of configurations that are encompassed by the CFXTEN fusion proteins of the invention; numerous other variations will be apparent to the ordinarily skilled artisan, including the incorporation the spacer and cleavage sequences disclosed herein or known in the art.

TABLE 6

| CFXTEN configurations | |
|---|---|
| Components* | Configuration** |
| Single CF; Single XTEN | CF-XTEN |
| | XTEN-CF |
| Single CF; Multiple XTEN | XTEN-CF-XTEN |
| | CF-XTEN-XTEN |
| | XTEN-XTEN-CF |
| | XTEN-CF-XTEN-XTEN |
| | XTEN-XTEN-CF-XTEN |
| | XTEN-XTEN-CF-XTEN |
| Multiple CF, Single XTEN | CF-XTEN-CF |
| | XTEN-CF-CF |
| | CF-CF-XTEN |
| | CF-XTEN-CF-CF |
| Multiple CF; Multiple XTEN | CF-XTEN-CF-XTEN |
| | XTEN-CF-XTEN-CF |
| | XTEN-XTEN-CF-XTEN-CF |
| | XTEN-XTEN-CF-CF |
| | CF-XTEN-XTEN-CF |
| | CF-CF-XTEN-XTEN |

TABLE 6-continued

| CFXTEN configurations | |
|---|---|
| Components* | Configuration** |
| | CF-CF-XTEN-XTEN-CF |
| | CF-XTEN-CF-XTEN-CF |

*Characterized as single for 1 component or multiple for 2 or more of that component
**Reflects N- to C-terminus configuration of the growth factor and XTEN components The invention contemplates CFXTEN fusion proteins compositions comprising, but not limited to single or multiple CF selected from Table 1 or Table 2 (or fragments or sequence variants thereof), single or multiple XTEN selected from Table 4 (or sequence variants thereof) that are in a configuration shown in Table 6. Non-limiting examples of sequences of fusion proteins containing a single CF linked to a single XTEN are presented in Table 41. In one embodiment, a CFXTEN composition would comprise a fusion protein having at least about 80% sequence identity compared to a CFXTEN from Table 41, alternatively at least about 81%, 82%, 83%, 84%, 85%, 86%, 87%, 88%, 89% 90%, 91%, 92%, 93%, 94%, 95%, 96%, 97%, 98%, 99%, or about 100% sequence identity as compared to a CFXTEN from Table 41. Generally, the resulting CFXTEN retains at least a portion of the biological activity of the corresponding CF not linked to the XTEN. In the foregoing fusion proteins hereinabove described in this paragraph, the CFXTEN fusion protein can further comprise a cleavage sequence from Table 7; the cleavage sequence being located between the CF and the XTEN or between adjacent CF (if more than one CF is included in the CFXTEN). In some cases, the CFXTEN comprising the cleavage sequences will also have one or more spacer sequence amino acids between the CF and the cleavage sequence or the XTEN and the cleavage sequence to facilitate access of the protease; the spacer amino acids comprising any natural amino acid, including glycine and alanine as preferred amino acids. Non-limiting examples of CFXTEN comprising CF, XTEN, cleavage sequence(s) and spacer amino acids are presented in Table 42. However, the invention also contemplates substitution of any of the CF sequences of Tables 1 and 2 for a CF sequence of Table 42, substitution of any XTEN sequence of Table 4 for an XTEN sequence of Table 42, and substitution of any cleavage sequence of Table 7 for a cleavage sequence of Table 42. In CFXTEN embodiments having one or more cleavage sequences, the CF component either becomes biologically active or has an increase in activity upon its release from the XTEN by cleavage of the cleavage sequence(s), described more fully below.

In one embodiment of the CFXTEN composition, the invention provides a fusion protein of formula I:

$$(XTEN)_x\text{-}CF\text{-}(XTEN)_y \qquad \qquad I$$

wherein independently for each occurrence, CF is a coagulation factor; x is either 0 or 1 and y is either 0 or 1 wherein x+y≥1; and XTEN is an extended recombinant polypeptide.

In another embodiment of the CFXTEN composition, the invention provides a fusion protein of formula II:

$$(XTEN)_x\text{-}(CF)\text{-}(S)_y\text{-}(XTEN)_y \qquad \qquad II$$

wherein independently for each occurrence, CF is a coagulation factor a; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment of the CFXTEN composition, the invention provides an isolated fusion protein, wherein the fusion protein is of formula III:

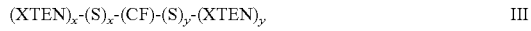

$(XTEN)_x-(S)_x-(CF)-(S)_y-(XTEN)_y$  III wherein independently for each occurrence, CF is a coagulation factor; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment of the CFXTEN composition, the invention provides an isolated fusion protein of formula IV:

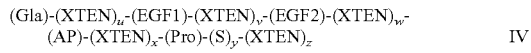

$(Gla)-(XTEN)_u-(EGF1)-(XTEN)_v-(EGF2)-(XTEN)_w-(AP)-(XTEN)_x-(Pro)-(S)_y-(XTEN)_z$  IV wherein independently for each occurrence, Gla is a Gla domain of FIX; EGF1 is an EGF1 domain of FIX; EGF2 is an EFG2 domain of FIX; AP is an activator peptide of FIX; PRO is a protease domain of FIX; S is a spacer sequence having between 1 to about 50 amino acid residues that can optionally include a cleavage sequence; u is either 0 or 1; v is either 0 or 1; x is either 0 or 1; y is either 0 or 1, z is either 0 or 1, with the proviso that u+v+x+z≥1; and XTEN is an extended recombinant polypeptide.

In another embodiment of the CFXTEN composition, the invention provides an isolated fusion protein of formula V:

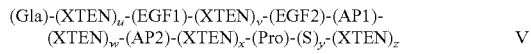

$(Gla)-(XTEN)_u-(EGF1)-(XTEN)_v-(EGF2)-(AP1)-(XTEN)_w-(AP2)-(XTEN)_x-(Pro)-(S)_y-(XTEN)_z$  V wherein independently for each occurrence, Gla is a Gla domain of FIX; EGF1 is an EGF1 domain of FIX; EGF2 is an EFG2 domain of FIX; AP1 is the N-terminal sequence portion of the activator peptide domain of FIX that includes a first native cleavage sequence of the AP domain; AP2 is the C-terminal sequence portion of the activator peptide domain of FIX that includes a second native cleavage sequence of the AP domain; PRO is a protease domain of FIX; S is a spacer sequence having between 1 to about 50 amino acid residues that can optionally include a cleavage sequence; u is either 0 or 1; v is either 0 or 1; w is 0 or 1, x is either 0 or 1; y is either 0 or 1; z is either 0 or 1 with the proviso that u+v+w+x+z≥1; and XTEN is an extended recombinant polypeptide.

In another embodiment of the CFXTEN composition, the invention provides an isolated fusion protein of formula VI:

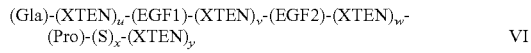

$(Gla)-(XTEN)_u-(EGF1)-(XTEN)_v-(EGF2)-(XTEN)_w-(Pro)-(S)_x-(XTEN)_y$  VI wherein independently for each occurrence, Gla is a Gla domain of FVII; EGF1 is an EGF1 domain of FVII; EGF2 is an EFG2 domain of FVII; PRO is a protease domain of FVII; S is a spacer sequence having between 1 to about 50 amino acid residues that can optionally include a cleavage sequence; u is either 0 or 1; v is either 0 or 1; x is either 0 or 1; y is either 0 or 1; and XTEN is an extended recombinant polypeptide.

In another embodiment of the CFXTEN composition, the invention provides an isolated fusion protein of formula VII:

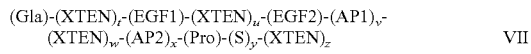

$(Gla)-(XTEN)_t-(EGF1)-(XTEN)_u-(EGF2)-(AP1)_v-(XTEN)_w-(AP2)_x-(Pro)-(S)_y-(XTEN)_z$  VII wherein independently for each occurrence, Gla is a Gla domain of FVII; EGF1 is an EGF1 domain of FVII; EGF2 is an EFG2 domain of FVII; PRO is a protease domain of FVII; AP1 is the N-terminal sequence portion of the activator peptide domain of FIX that includes the native cleavage sequence; AP2 is the C-terminal sequence portion of the activator peptide domain of FIX that includes the native cleavage sequence; S is a spacer sequence having between 1 to about 50 amino acid residues that can optionally include a cleavage sequence; t is either 0 or 1; u is either 0 or 1; v is either 0 or 1; x is either 0 or 1; y is either 0 or 1; z is either 0 or 1; and XTEN is an extended recombinant polypeptide. In the embodiment, the factor VII variant includes can include one or both cleavage sequences from the activator peptide domain of factor IX; e.g., a sequence of at least about 2, or at least about 3, or at least about 4, or at least about 5 amino acids that flank the R145-A146 cleavage site (e.g., the sequence TSKLTRAETVFP (SEQ ID NO: 3) in the case of 5 flanking amino acids) and the sequence of at least about 2, or at least about 3, or at least about 4, or at least about 5 amino acids that flank the R180-V181 cleavage site (e.g., the sequence FND-FTRVVGGED (SEQ ID NO: 85) in the case of 5 flanking amino acids, as described more fully above. The invention also contemplates substitution of any of the other cleavage sequences of Table 7 for the AP sequences of the factor VII variant.

The embodiments of formulae V and VI encompass CFXTEN configurations of factor IX and factor VII, respectively, wherein one or more XTEN of lengths ranging from about 36 amino acids to 1000 amino acids (e.g., sequences selected from Tables 4, and 9-13) are inserted and linked between adjoining domains of the factor IX or the factor VII sequence, respectively. The invention contemplates all possible permutations of insertions of XTEN between the domains of either FIX or FVII with optional linking of an additional XTEN to the C-terminus of the FIX or the FVII, optionally via an additional cleavage sequence selected from Table 7, resulting in a CFXTEN composition; non-limiting examples of which are portrayed in FIGS. 2, 5 and 6. In the foregoing embodiments hereinabove described in this paragraph, the CFXTEN fusion proteins can be evaluated for retention of biological activity (including after cleavage of any incorporated XTEN-releasing cleavage sites) using any appropriate in vitro assay disclosed herein (e.g., the assays of Table 40 or the assays described in the Examples), to determine the suitability of the configuration for use as a therapeutic agent in the treatment of a coagulation-factor related disease, disorder or condition.

In some embodiments, administration of a therapeutically effective amount of a fusion protein of one of formulae I-VII to a subject in need thereof results in an increase of at least two-fold in the terminal half-life, or at least three-fold, or at least four-fold, or at least five-fold, or at least 10-fold, or at least 20-fold, or at least 40-fold, or at least 100-fold increase in the terminal half-life for the fusion protein compared to the corresponding CF not linked to the XTEN and administered at a comparable amount administered to a subject. In some embodiments, administration of a therapeutically effective amount of a fusion protein of one of formulae I-VII to a subject in need thereof results in a gain in time of at least two-fold, or at least three-fold, or at least four-fold, or at least five-fold, or at least 10-fold, or at least 20-fold, or at least 40-fold, or at least 100-fold or more spent within a therapeutic window for the fusion protein compared to the corresponding CF not linked to the XTEN and administered at a comparable amount administered to a subject. In other embodiments, administration of a therapeutically effective dose of a fusion protein of one of formulae I-VII to a subject in need thereof can result in a gain in time between consecutive doses necessary to maintain a therapeutically effective blood level of the fusion protein of at least 48 h, or at least 72 h, or at least about 96 h, or at least about 120 h, or at least about 7 days, or at least about 14 days, or at least about 21 days between consecutive doses compared to a CF not linked to XTEN and administered at a comparable dose.

Any spacer sequence group optionally is introduced to a subject fusion protein encompassed by the invention. The spacer is provided to enhance expression of the fusion protein from a host cell or to decrease steric hindrance such that the CF component may assume its desired tertiary structure and/or interact appropriately with its target substrate. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) and proline (P). In some cases, the spacer can be polyglycines or polyalanines, or is predominately a mixture of combinations of glycine and alanine residues. The spacer polypeptide exclusive of a cleavage sequence is largely to substantially devoid of secondary structure; e.g., less than about 10%, or less than about 5% as determined by the Chou-Fasman and/or GOR algorithms. In one embodiment, a spacer sequence in a CFXTEN fusion protein composition further contains one or more cleavage sequences, which are identical or different, wherein the cleavage sequence may be acted on by a protease to release the CF from the fusion protein.

In some embodiments, the incorporation of the cleavage sequence into the CFXTEN is designed to permit release of a CF that becomes active or more active upon its release from the XTEN; e.g., the enzymatic activity of the CF component increases. In one embodiment of the foregoing, the CF that becomes active after release is a FIX or a sequence variant thereof. In another embodiment of the foregoing, the CF that becomes active after release is a FVII or a sequence variant thereof The cleavage sequences are located sufficiently close to the CF sequences, generally within 18, or within 12, or within 6, or within 2 amino acids of the CF sequence terminus, such that any remaining residues attached to the CF after cleavage do not appreciably interfere with the activity (e.g., such as binding to a ligand or substrate) of the CF, yet provide sufficient access to the protease to be able to effect cleavage of the cleavage sequence. In some embodiments, the cleavage site is a sequence that can be cleaved by a protease endogenous to the mammalian subject such that the CFXTEN can be cleaved after administration to a subject. In such cases, the CFXTEN can serve as a prodrug or a circulating depot for the CF. In one embodiment, the CF that is released from the fusion protein by cleavage of the cleavage sequence exhibits at least about a two-fold, or at least about a three-fold, or at least about a four-fold, or at least about a five-fold, or at least about a six-fold, or at least about a eight-fold, or at least about a ten-fold, or at least about a 20-fold increase in enzymatic activity for its native substrate compared to the intact CFXTEN fusion protein.

Examples of cleavage sites contemplated by the invention include, but are not limited to, a polypeptide sequence cleavable by a mammalian endogenous protease selected from FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases and others are known in the art. Exemplary cleavage sequences and cut sites within the sequences are presented in Table 7, as well as sequence variants thereof. For example, thrombin (activated clotting factor II) acts on the sequence LTPRSLLV (SEQ ID NO: 86) [Rawlings N. D., et al. (2008) *Nucleic Acids Res.*, 36: D320], which is cut after the arginine at position 4 in the sequence. Active FIIa is produced by cleavage of FII by FXa in the presence of phospholipids and calcium and is down stream from factor IX in the coagulation pathway. Once activated, its natural role in coagulation is to cleave fibrinogen, which then in turn, begins clot formation. FIIa activity is tightly controlled and only occurs when coagulation is necessary for proper hemostasis. However, as coagulation is an on-going process in mammals, by incorporation of the LTPRSLLV (SEQ ID NO: 86) sequence into the CFXTEN between and linking the CF and the XTEN components, the XTEN is removed from the adjoining CF concurrent with activation of either the extrinsic or intrinsic coagulation pathways when coagulation is required physiologically, thereby releasing CF over time. Similarly, incorporation of other cleavage sequences into CFXTEN that are acted upon by endogenous proteases, particularly those susceptible to the activated clotting proteins listed in Table 7, would provide for sustained release of CF that, in certain embodiments of the CFXTEN, provide a higher degree of activity for the CF component released from the intact form of the CFXTEN. In one embodiment, the invention provides CFXTEN comprising one or more cleavage sequences operably positioned to release the CF from the fusion protein upon cleavage, wherein the one or more cleavage sequences has at least about 86%, or at least about 92% or greater sequence identity to a sequence selected from Table 7. In another embodiment, the CFXTEN comprising a cleavage sequence would have at least about 80%, or at least about 85%, or at least about 90%, or at least about 95%, or at least about 96%, or at least about 97%, or at least about 98%, or at least about 99% sequence identity compared to a sequence selected from Table 42.

In some embodiments, only the two or three amino acids flanking both sides of the cut site (four to six amino acids total) are incorporated into the cleavage sequence that, in turn, is incorporated into the CFXTEN of the embodiments. In other embodiments, the known cleavage sequence have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the CF from the XTEN. Exemplary substitutions are shown in Table 7.

TABLE 7

Protease Cleavage Sequences

| Protease Acting Upon Sequence | Exemplary Cleavage Sequence | SEQ ID NO: | Minimal Cut Site* | SEQ ID NO: |
|---|---|---|---|---|
| FXIa | KLTR↓AET | 87 | KD/FL/T/R↓VA/VE/GT/GV | |
| FXIa | DFTR↓VVG | 88 | KD/FL/T/R↓VA/VE/GT/GV | |
| FXIIa | TMTR↓IVGG | 89 | NA | |
| Kallikrein | SPFR↓STGG | 90 | —/—/FL/RY↓SR/RT/—/— | |

TABLE 7-continued

Protease Cleavage Sequences

| Protease Acting Upon Sequence | Exemplary Cleavage Sequence | SEQ ID NO: | Minimal Cut Site* | SEQ ID NO: |
|---|---|---|---|---|
| FVIIa | LQVR↓IVGG | 91 | NA | |
| FIXa | PLGR↓IVGG | 92 | —/—/G/R↓—/—/—/— | |
| FXa | IEGR↓TVGG | 93 | IA/E/GFP/R↓STI/VFS/—/G | |
| FIIa (thrombin) | LTPR↓SLLV | 94 | —/—/PLA/R↓SAG/—/—/— | |
| Elastase-2 | LGPV↓SGVP | 95 | —/—/—/V/IAT↓—/—/—/— | |
| Granzyme-B | VAGD↓SLEE | 96 | V/—/—/D↓—/—/—/— | |
| MMP-12 | GPAG↓LGGA | 97 | G/PA/—/G↓L/—/G/— | 98 |
| MMP-13 | GPAG↓LRGA | 99 | G/P/—/G↓L/—/GA/— | 100 |
| MMP-17 | APLG↓LRLR | 101 | —/PS/—/—↓LQ/—/LT/— | |
| MMP-20 | PALP↓LVAQ | 102 | NA | |
| TEV | ENLYFQ↓G | 103 | ENLYFQ↓G/S | 104 |
| Enterokinase | DDDK↓IVGG | 105 | DDDK↓IVGG | 106 |
| Protease 3C (PreScission ™) | LEVLFQ↓GP | 107 | LEVLFQ↓GP | 108 |
| Sortase A | LPKT↓GSES | 109 | L/P/KEAD/T↓G/—/EKS/S | 110 |

↓indicates cleavage site
NA: not applicable
*the listing of multiple amino acids before, between, or after a slash indicate alternative amino acids that can be substituted at the position; "—" indicates that any amino acid may be substituted for the corresponding amino acid indicated in the middle column (a) Pharmacokinetic Properties of CFXTEN The invention provides CFXTEN fusion proteins with enhanced pharmacokinetics compared to the CF not linked to XTEN. The pharmacokinetic properties of a CF that can be enhanced by linking a given XTEN to the CF include, but are not limited to, terminal half-life, area under the curve (AUC), $C_{max}$, volume of distribution, and bioavailability; properties that provide enhanced utility in the treatment of coagulation factor-related disorders, diseases and related conditions. As a result of the enhanced properties, the CFXTEN, when used at the dose and dose regimen determined to be appropriate for the composition by the methods described herein, can achieve a circulating concentration resulting in a desired pharmacologic effect, yet stay within the safety range for biologically active component of the composition for an extended period of time compared to a comparable dose of the CF not linked to XTEN. In such cases, the CFXTEN remains within the therapeutic window for the fusion protein composition for the extended period of time compared to a CF not liked to XTEN and administered to a subject at a comparable dose. As used herein, a "comparable dose" means a dose with an equivalent moles/kg for the active CF pharmacophore (e.g., FIX or FVII) that is administered to a subject in a comparable fashion. It will be understood in the art that a "comparable dosage" of CFXTEN fusion protein would represent a greater weight of agent but would have essentially the same mole-equivalents of CF in the dose of the fusion protein administered.

In some embodiments, the CFXTEN with enhanced pharmacokinetic properties can be a sequence that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a protein sequence selected from any one of Tables 41, 42, or 43. In other embodiments, the CFXTEN with enhanced pharmacokinetic properties can comprise a CF sequence that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or about 99% sequence identity compared to a sequence from Table 1 or from Table 2, linked to one or more XTEN that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or about 99% sequence identity compared to a sequence from Table 4. For the inventive compositions, CFXTEN with a longer terminal half-life are generally preferred, so as to improve patient convenience, to increase the interval between doses and to reduce the amount of drug required to achieve a sustained effect. In the embodiments hereinabove described in this paragraph the administration of the fusion protein results in an improvement in at least one of the parameters (disclosed herein as being useful for assessing the subject diseases, conditions or disorders) using a lower unit dose in moles of fusion protein compared to the corresponding CF component not linked to the fusion protein and administered at a comparable unit dose or dose regimen to a subject. In the foregoing embodiments, the total dose in moles administered to achieve the improvement is at least about three-fold lower, or at least about four-fold, or at least about five-fold, or at least about six-fold, or at least about eight-fold, or at least about 10-fold lower compared to the corresponding CF component not linked to the fusion protein.

As described more fully in the Examples pertaining to pharmacokinetic characteristics of fusion proteins comprising XTEN, it was observed that increasing the length of the XTEN sequence confers a disproportionate increase in the terminal half-life of a fusion protein comprising the XTEN. Accordingly, the invention provides CFXTEN fusion proteins comprising XTEN wherein the XTEN is selected to provide a targeted half-life for the CFXTEN composition administered to a subject. In some embodiments, the invention provides monomeric fusion proteins comprising XTEN wherein the XTEN is selected to confer an increase in the terminal half-life for the CFXTEN administered to a subject, compared to the corresponding CF not linked to the fusion protein and administered at a comparable dose, wherein the increase is at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least a 40-fold, or at least a 80-fold, or at least a 100-fold or greater an increase in terminal half-life compared to the CF not linked to the fusion protein. Exogenously administered factor IX has been reported to have a terminal half-life in humans of approximately 18-24 hours (Morfini, M. Blood Transfus. (2008) 6(s2): s21-s25) and exogenously administered factor VII is reported to have a terminal half-life of approximately 4-6 hours (Klitgaard T, Br J Clin Pharmacol (2008) 65(1):3-11), whereas various CFXTEN compositions disclosed herein that have been experimentally administered to animals, as described in the Examples, have resulted in terminal half-life values considerably longer. In one embodiment, the present invention provides CFXTEN fusion proteins that exhibits an increase in ACU of at least about 50%, or at least about 60%, or at least about 70%, or at least about 80%, or at least about 90%, or at least about a 100%, or at least about 150%, or at least about 200%, or at least about 300%, or at least about 500%, or at least about 1000%, or at least about a 2000% compared to the corresponding CF not linked to the XTEN and administered to a subject at a comparable dose. The pharmacokinetic parameters of a CFXTEN can be determined by standard methods involving dosing, the taking of blood samples at times intervals, and the assaying of the protein using ELISA, HPLC, radioassay, or other methods known in the art or as described herein, followed by standard calculations of the data to derive the half-life and other PK parameters.

The enhanced PK parameters allow for reduced dosing of the CFXTEN compositions, compared to CF not linked to XTEN. In some embodiments, a smaller molar amount of about two-fold less, or about three-fold less, or about four-fold less, or about five-fold less, or about six-fold less, or about eight-fold less, or about 10-fold less or greater of the fusion protein is administered in comparison to the corresponding CF not linked to the XTEN under a dose regimen needed to maintain hemostasis, and the fusion protein achieves a comparable area under the curve as the corresponding molar amount of the CF not linked to the XTEN. In other embodiments, the fusion protein has a less frequent administration regimen of about every two days, about every seven days, about every 14 days, about every 21 days, or about monthly of the fusion protein administered to a subject, compared to the daily administration of an otherwise same dose amount of the corresponding CF not linked to the XTEN, and the fusion protein achieves a comparable area under the curve as the corresponding CF not linked to the XTEN. In yet other embodiments, an accumulative smaller molar amount of about 5%, or about 10%, or about 20%, or about 40%, or about 50%, or about 60%, or about 70%, or about 80%, or about 90% less of the fusion protein is administered to a subject in comparison to the corresponding molar amount of the CF not linked to the XTEN under a dose regimen needed to maintain hemostasis, yet the fusion protein achieves at least a comparable area under the curve as the corresponding CF not linked to the XTEN. The accumulative smaller molar amount is measure for a period of at least about one week, or about 14 days, or about 21 days, or about one month.

The invention further provides CFXTEN comprising a CF molecule separated from the XTEN sequence by one or more cleavage sequences; e.g., a sequence from Table 7. In some embodiments, the intact CFXTEN composition has less activity but a longer half-life in its intact form compared to a corresponding CF not linked to the XTEN, but is designed such that upon administration to a subject, the CF component is gradually released from the fusion protein by cleavage at the cleavage sequence(s) by endogenous proteases, whereupon the CF component exhibits activity, i.e., the ability to effectively bind to and activate its target coagulation protein substrate. In non-limiting examples, the CFXTEN with a cleavage sequence has about 80% sequence identity compared to a sequence from Table 42, or about 85%, or about 90%, or about 95%, or about 97%, or about 98%, or about 99% sequence identity compared to a sequence from Table 42. Accordingly, the CFXTEN of the foregoing embodiments in this paragraph serve as prodrugs or a circulating depot, resulting in a longer terminal half-life compared to CF not linked to the XTEN. In such cases, a higher concentration of CFXTEN can be administered to a subject, compared to the corresponding CF not linked to XTEN because a smaller proportion of the circulating composition is active.

(b) Pharmacology and Pharmaceutical Properties of CFXTEN

The present invention provides CFXTEN compositions comprising CF covalently linked to XTEN that can have enhanced properties compared to CF not linked to XTEN, as well as methods to enhance the therapeutic and/or biologic activity or effect of the respective two CF components of the compositions. In addition, the invention provides CFXTEN compositions with enhanced properties compared to those art-known fusion proteins containing albumin, immunoglobulin polypeptide partners, polypeptides of shorter length and/or polypeptide partners with repetitive sequences. In addition, CFXTEN fusion proteins provide significant advantages over chemical conjugates, such as pegylated constructs, notably the fact that recombinant CFXTEN fusion proteins can be made in bacterial cell expression systems, which can reduce time and cost at both the research and development and manufacturing stages of a product, as well as result in a more homogeneous, defined product with less toxicity for both the product and metabolites of the CFXTEN compared to pegylated conjugates.

As therapeutic agents, the CFXTEN possesses a number of advantages over therapeutics not comprising XTEN, including one or more of the following non-limiting exemplary enhanced properties: increased solubility, increased thermal stability, reduced immunogenicity, increased apparent molecular weight, reduced renal clearance, reduced proteolysis, reduced metabolism, enhanced therapeutic efficiency, a lower effective therapeutic dose, increased bioavailability, increased time between dosages capable of maintaining blood levels within the therapeutic window for the CF, a "tailored" rate of absorption when administered subcutaneously or intramuscularly, enhanced lyophilization stability, enhanced serum/plasma stability, increased terminal half-life, increased solubility in blood stream, decreased binding by neutralizing antibodies, decreased active clearance, reduced side effects, retention of substrate binding affinity, stability to degradation, stability to freeze-thaw, stability to proteases, stability to ubiquitination, ease of administration, compatibility with other pharmaceutical excipients or carriers, persistence in the subject, increased stability in storage (e.g., increased shelf-life), reduced toxicity in an organism or environment and the like. The net effect of the enhanced properties is that the use of a CFXTEN composition can result in enhanced therapeutic and/or biologic effect compared to a CF not linked to XTEN or result in improved patient compliance when administered to a subject with a coagulation factor-related disease or disorder.

Specific assays and methods for measuring the physical and structural properties of expressed proteins are known in the art, including methods for determining properties such as protein aggregation, solubility, secondary and tertiary structure, melting properties, contamination and water content, etc. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy; several of which are applied to the inventive CFXTEN as described in the Examples. Additional methods are disclosed in Arnau et al, Prot Expr and Purif (2006) 48, 1-13. Application of these methods to elucidate the enhanced properties of the compositions of the invention is within the grasp of a person skilled in the art.

In one embodiment, XTEN as a fusion partner increases the solubility of the CF payload. Accordingly, where enhancement of the pharmaceutical or physicochemical properties of the CF is desirable, such as the degree of aqueous solubility or stability, the length and/or the motif family composition of the XTEN sequences incorporated into the fusion protein may each be selected to confer a different degree of solubility and/or stability on the respective fusion proteins such that the overall pharmaceutical properties of the CFXTEN composition are enhanced. The CFXTEN fusion proteins can be constructed and assayed, using methods described herein, to confirm the physicochemical properties and the XTEN adjusted, as needed, to result in the desired properties. In one embodiment, the XTEN sequence of the CFXTEN is selected such that the fusion protein has an aqueous solubility that is within at least about 25% greater compared to a CF not linked to the fusion protein, or at least about 30%, or at least about 40%, or at least about 50%, or at least about 75%, or at least about 100%, or at least about 200%, or at least about 300%, or at least about 400%, or at least about 500%, or at least about 1000% greater than the corresponding CF not linked to the fusion protein.

The invention provides methods to produce and recover expressed CFXTEN from a host cell with enhanced solubility and ease of recovery compared to CF not linked to XTEN. In some embodiments, the method includes the steps of transforming a eukaryotic host cell with a polynucleotide encoding a CFXTEN with one or more XTEN components of cumulative sequence length greater than about 200, or greater than about 400, or greater than about 600, or greater than about 800 amino acid residues, expressing the CFXTEN fusion protein in the host cell, and recovering the expressed fusion protein in soluble form. In the embodiments hereinabove described in this paragraph, the XTEN of the CFXTEN fusion proteins can have at least about 80% sequence identity, or about 90%, or about 91%, or about 92%, or about 93%, or about 94%, or about 95%, or about 96%, or about 97%, or about 98%, or about 99%, to about 100% sequence identity compared to one or more XTEN selected from Table 4 and the CF can have at least about 80% sequence identity, or about 90%, or about 91%, or about 92%, or about 93%, or about 94%, or about 95%, or about 96%, or about 97%, or about 98%, or about 99%, or 100% sequence identity compared to a CF selected from Table 1 or Table 2 and the CFXTEN components can be in an N- to C-terminus configuration selected from formulas I-VII.

In one embodiment, the invention provides CFXTEN compositions and methods to produce the compositions that can maintain the CF component within a therapeutic window for a greater period of time compared to comparable dosages of the corresponding CF not linked to XTEN. It will be understood in the art that a "comparable dosage" of CFXTEN fusion protein would represent a greater weight of agent but would have the same approximate mole-equivalents of CF in the dose of the fusion protein and/or would have the same approximate molar concentration relative to the CF. The method to produce the compositions that can maintain the CF component within a therapeutic window includes the steps of selecting the XTEN appropriate for conjugation to a CF to provide the desired pharmacokinetic properties in view of a given dose and dose regimen, administration of the CFXTEN to subjects in need thereof, followed by assays to verify the pharmacokinetic properties, the activity of the CFXTEN fusion protein, and the safety of the administered composition. By the methods, CFXTEN provided herein allow for increased efficacy of the administered composition by maintaining the circulating concentrations of the CF within the therapeutic window for an enhanced period of time. As used herein, "therapeutic window" means that the amount of drug or biologic as a blood or plasma concentration range, which provides efficacy or a desired pharmacologic effect over time for the disease or condition without unacceptable toxicity, i.e., the range of the circulating blood concentrations between the minimal amount to achieve any positive therapeutic effect and the maximum amount which results in a response that is the response immediately before toxicity to the subject (at a higher dose or concentration). Additionally, therapeutic window generally encompasses an aspect of time; the maximum and minimum concentration that results in a desired pharmacologic effect over time that does not result in unacceptable toxicity or adverse events. A dosed composition that stays within the therapeutic window for the subject could also be said to be within the "safety range."

The characteristics of CFXTEN compositions of the invention, including functional characteristics or biologic and pharmacologic activity and parameters that result, can be determined by any suitable screening assay known in the art for measuring the desired characteristic. The invention provides methods to assay the CFXTEN fusion proteins of differing composition or configuration in order to provide CFXTEN with the desired degree of biologic and/or therapeutic activity, as well as safety profile. Specific in vivo and ex vivo biological assays are used to assess the activity of each configured CFXTEN and/or CF component to be incorporated into CFXTEN, including but not limited to the assays of the Examples, those assays of Table 40, as well as the following assays or other such assays known in the art for assaying the properties and effects of CF. Functional assays can be conducted that allow determination of coagulation activity, such as prothrombin (PT) and activated partial prothrombin (aPTT) assays (Belaaouaj A A et al., J. Biol. Chem. (2000) 275:27123-8; Diaz-Collier J A. Haemost (1994) 71:339-46), blood clotting time (WBCT), thrombelastography, or bleeding time assays. Other possible assays may determine the binding affinity of a CFXTEN for the target substrate of the corresponding CF can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The foregoing assays can also be used to assess CF sequence variants (assayed as single components or as CFXTEN fusion proteins) and can be compared to the native CF to determine whether they have the same degree of biologic activity as the native CF, or some fraction thereof such that they are suitable for inclusion in CFXTEN; e.g., at least about 60%, or at least about 70%, or at least about 80%, or at least about 90% of the activity compared to the native CF.

Dose optimization is important for all drugs, especially for those with a narrow therapeutic window. For example, a standardized single dose of CF for all patients presenting with a diverse symptoms or abnormal clinical parameters may not always be effective. A consideration of these factors is well within the purview of the ordinarily skilled clinician for the purpose of determining the therapeutically or pharmacologically effective amount of the CFXTEN, versus that amount that would result in unacceptable toxicity and place it outside of the safety range, or insufficient potency such that clinical improvement is not achieved.

In many cases, the therapeutic window for CF in subjects of different ages or degree of disease have been established and are available in published literature or are stated on the drug label for approved products containing the CF. In other cases, the therapeutic window can be established for new compositions, including those CFXTEN of the disclosure. The methods for establishing the therapeutic window for a given composition are known to those of skill in the art (see, e.g., Goodman & Gilman's The Pharmacological Basis of Therapeutics, $11^{th}$ Edition, McGraw-Hill (2005)). For example, by using dose-escalation studies in subjects with the target disease or disorder to determine efficacy or a desirable pharmacologic effect, appearance of adverse events, and determination of circulating blood levels, the therapeutic window for a given subject or population of subjects can be determined for a given drug or biologic, or combinations of biologics or drugs. The dose escalation studies can evaluate the activity of a CFXTEN through metabolic studies in a subject or group of subjects that monitor physiological or biochemical parameters, as known in the art or as described herein for one or more parameters associated with the metabolic disease or disorder, or clinical parameters associated with a beneficial outcome for the particular indication, together with observations and/or measured parameters to determine the no effect dose, adverse events, maximum tolerated dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs and above which toxicity occurs, thereby establishing the therapeutic window for the dosed therapeutic. Blood concentrations of the fusion protein (or as measured by the CF component) above the maximum is considered outside the therapeutic window or safety range. Thus, by the foregoing methods, a $C_{min}$ blood level is established, below which the CFXTEN fusion protein would not have the desired pharmacologic effect, and a $C_{max}$ blood level is established that would represent the highest circulating concentration before reaching a concentration that would elicit unacceptable side effects, toxicity or adverse events, placing it outside the safety range for the CFXTEN. With such concentrations established, the frequency of dosing and the dosage can be further refined by measurement of the $C_{max}$ and $C_{min}$ to provide the appropriate dose and dose frequency to keep the fusion protein(s) within the therapeutic window.

One of skill in the art can, by the means disclosed herein or by other methods known in the art, confirm that the administered CFXTEN remains in the therapeutic window for the desired interval or requires adjustment in dose or length or sequence of XTEN. Further, the determination of the appropriate dose and dose frequency to keep the CFXTEN within the therapeutic window establishes the therapeutically effective dose regimen; the schedule for administration of multiple consecutive doses using a therapeutically effective dose of the fusion protein to a subject in need thereof resulting in consecutive $C_{max}$ peaks and/or $C_{min}$ troughs that remain within the therapeutic window and results in an improvement in at least one measured parameter relevant for the target disease, disorder or condition. In some cases, the CFXTEN administered at an appropriate dose to a subject results in blood concentrations of the CFXTEN fusion protein that remains within the therapeutic window for a period at least about two-fold longer compared to the corresponding CF not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer or greater compared to the corresponding CF not linked to XTEN and administered at a comparable dose. As used herein, an "appropriate dose" means a dose of a drug or biologic that, when administered to a subject, would result in a desirable therapeutic or pharmacologic effect and/or a blood concentration within the therapeutic window.

In one embodiment, the CFXTEN administered at a therapeutically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the fusion protein and administered at a comparable dose regimen to a subject. In another embodiment, the CFXTEN administered at a therapeutically effective dose regimen results in a comparable improvement in one, or two, or three or more measured parameter using less frequent dosing or a lower total dosage in moles of the fusion protein of the pharmaceutical composition compared to the corresponding biologically active protein component(s) not linked to the fusion protein and administered to a subject using a therapeutically effective dose regimen for the CF. The measured parameters include any of the clinical, biochemical, or physiological parameters disclosed herein, or others known in the art for assessing subjects with coagulation factor-related disorders.

In some embodiments, the CFXTEN fusion proteins of the invention retain at least about 0.05%, or about 0.1%, or about 1%, or about 10%, or about 20%, or about 30%, or about 40%, or about 50%, or about 60%, or about 70%, or about 80%, or about 90%, or about 95%, or about 98%, or about 99% percent of the biological activity of the corresponding CF not linked to the fusion protein with regard to an in vitro biologic activity or pharmacologic effect known or associated with the use of the native CF in the treatment and prevention of coagulation factor-related diseases, disorders, and conditions. Non-limiting examples of parameters or physiologic effects that can be assayed to assess the retained activity of the CFXTEN fusion proteins include prothrombin time (PT), activated partial thromboplastin time (aPTT), bleeding time, whole blood clotting time (WBCT), and thrombelastography. In some embodiments, the activity of the CF component is manifested by the intact CFXTEN fusion protein, while in other cases the activity of the CF component is primarily manifested upon cleavage and release of the CF from the fusion protein by action of a protease that acts on a cleavage sequence incorporated into the CFXTEN fusion protein, embodiments of which are disclosed above. In the foregoing, the CFXTEN is designed to reduce the binding affinity of the CF component for the coagulation substrate when linked to the XTEN but have restored or increased affinity when released from XTEN through the cleavage of cleavage sequence(s) incorporated into the CFXTEN sequence, as described more fully above. In one embodiment of the foregoing, the invention provides an isolated fusion protein comprising a FIX linked to XTEN by a cleavage sequence, wherein the fusion protein is substantially inactive prior to cleavage and wherein the FIX released from the fusion protein by proteolytic cleavage at the cleavage sequence has biological activity that is at least about 60%, or at least about 70%, or at least about 80%, or at least about 90%, or at least about 95% as active compared to native FIX not linked to XTEN.

In other cases, the CFXTEN can be designed to reduce active clearance of the CFXTEN to increase the terminal half-life of CFXTEN administered to a subject, while still retaining biological activity. The clearance mechanisms to remove CF from the circulation have yet to be fully elucidated. Uptake, elimination, and inactivation of CFs can occur in the circulatory system as well as in the extravascular space. Coagulation factors are complex proteins that interact with a large number of other proteins, lipids, and receptors, and many of these interactions can contribute to the elimination of CFs from the circulation. For example, clearance mechanisms for FVII, a heterogeneously glycosylated protein, may include clearance by the liver. The effects of the gamma-carboxy glutamic acid (Gla) domain and the sialic acid content of the protein on FVIIa clearance have been investigated using a perfused liver model, with results suggesting that carbohydrate receptors (e.g. the asialoglycoprotein receptor, ASGPR) may play a role in FVIIa clearance. (Appa, R. S., et al. Thromb Haemost. (2010, epub May 27) 104(2)). In addition, CF can be lost through extravasation and rapid active clearance, which is reflected in the generally poor bioavailability of intravenously administered coagulation factors such as factor VIIa (see NovoSeven package insert). It is believed that the CFXTEN of the present invention has comparatively higher bioavailability achieved by reduced active clearance and/or by reduced extravasation by increasing the hydrodynamic radius, or apparent size, of the molecule by the addition of unstructured XTEN to the coagulation factor. In one embodiment, the invention provides CFXTEN that reduce clearance of the fusion protein by linking one or more XTEN to the CF component of the fusion protein, wherein the fusion protein has an increase in apparent molecular weight factor of at least about four-fold, or at least about five-fold, or at least about six-fold, or at least about seven-fold, or at least about eight-fold, or at least about ten-fold, or at least about twelve-fold, or at least about fifteen-fold, and wherein the terminal half-life of the CFXTEN when administered to a subject is increased at least about two-fold, or at least about four-fold, or at least about eight-fold, or at least about 10-fold, or at least about 20-fold, or at least about 30-fold, or at least about 40-fold, or at least about 50-fold, or at least about 60-fold, or at least about 70-fold, or at least about 80-fold or more compared to the corresponding CF not linked to XTEN. In the foregoing embodiment, wherein at least two XTEN molecules are incorporated into the CFXTEN, the XTEN can be identical or they can be of a different sequence composition (and net charge) or length. Non-limiting examples of the foregoing embodiment with two XTEN linked to a single FVII are illustrated in FIG. 6, and include the constructs (expressed using the domains of FVII) Gla-EGF1-EGF2-AE144-Protease-AE864 or Gla-EGF1-AE288-EGF2-Protease-AE864 (wherein the AE XTEN components have approximately a 17% net charge due to incorporated glutamic acid), Gla-EGF1-EGF2-AG144-Protease-AG864 or Gla-EGF1-AG144-EGF2-Protease-AG864 (wherein the AG XTEN components have approximately no net charge). Not to be bound by a particular theory, the XTEN of the CFXTEN compositions with the higher net charge are expected, as described above, to have less non-specific interactions with various negatively-charged surfaces such as blood vessels, tissues, or various receptors, which would further contribute to reduced active clearance. Conversely, the XTEN of the CFXTEN compositions with a low (or no) net charge are expected to have a higher degree of interaction with surfaces that, while contributing to active clearance, can potentiate the activity of the associated coagulation factor, given the known contribution of cell (e.g., platelets) and vascular surfaces to the coagulation process and the intensity of activation of coagulation factors (Zhou, R., et al., Biomaterials (2005) 26(16):2965-2973; London, F., et al. Biochemistry (2000) 39(32):9850-9858). Thus, the invention provides CFXTEN in which the degree of potency, bioavailability, and half-life can be tailored by the selection and placement of the type and length of the XTEN in the CFXTEN compositions. Accordingly, the invention contemplates compositions in which a CF from Table 1 or from Table 2 and XTEN from Table 4 are substituted for the respective components of the foregoing examples, and are produced, for example, in a configuration from Table 6 or from formulas I-VII such that the construct has reduced clearance compared to an alternative configuration of the respective components. In some embodiments, the foregoing method for increasing the terminal half-life provides configured CFXTEN that can result in an increase in the terminal half-life of at least about 30%, or about 50%, or about 75%, or about 100%, or about 150%, or about 200%, or about 300%, or about 400% or more compared to the half-life of a CFXTEN in a second configuration where active clearance is not reduced. The invention further takes advantage of the fact that certain ligands wherein reduced binding to a clearance receptor, either as a result of a decreased on-rate or an increased off-rate, may be effected by the obstruction of either the N- or C-terminus and using that terminus as the linkage to another polypeptide of the composition, whether another molecule of a CF, an XTEN, or a spacer sequence results in the reduced binding. The choice of the particular configuration of the CFXTEN fusion protein reduces the degree of binding to a clearance receptor such that a reduced rate of active clearance is achieved.

In cases where a reduction in active clearance is desired but retention of at least a portion of the biological activity is also desired, the CFXTEN is designed to retain sufficient biologic activity for the intact molecule. Thus, in one embodiment, the invention provides a CFXTEN configured such that the biologic activity of the CFXTEN is in the range of about 0.01%-40%, or about 0.01%-30%, or about 0.01%-20%, or about 0.01%-40 of the biological activity compared to the corresponding native coagulation factor. The biological activity of the configured CFXTEN is thus reduced by at least about 60%, or at least about 70%, or at least about 80%, or at least about 90%, or at least about 95%, or at least about 99%, or at least about 99.99% as compared to the biological activity of the corresponding native coagulation factor not linked to XTEN, determined under comparable conditions. In the foregoing embodiments, the biological activity of the configured CFXTEN for the target receptor is "substantially reduced" compared to a corresponding native CF not linked to XTEN. Accordingly, the present invention provides compositions and methods to produce compositions with reduced biological activity but increased half-life by configuring the CFXTEN, examples of which are provided above, so as to be able to provide a desired in vivo biological response yet avoid active clearance mechanisms. The increased half-life permits higher dosages and reduced frequency of dosing compared to CF not linked to XTEN or compared to CFXTEN configurations wherein the fusion protein is subject to coagulation factor clearance mechanisms.

VI). Uses of the Compositions of the Present Invention

In another aspect, the invention provides a method for achieving a beneficial effect in bleeding disorders and/or in a coagulation factor-related disease, disorder or condition mediated by FIX or FVII. As used herein, "coagulation factor-related diseases, disorders or conditions" is intended to include, but is not limited to bleeding disorders (e.g., defective platelet function, thrombocytopenia or von Willebrand's disease), coagulopathies (any disorder of blood coagulation, including coagulation factor deficiencies), hemophilia B (aka Christmas disease), factor IX-related bleeding disorders, factor VII deficiency, hemophilia A, vascular injury, uncontrolled bleeding in subjects not suffering from hemophilia, bleeding from trauma or surgery, bleeding due to anticoagulant therapy, and bleeding due to liver disease or conditions that can be ameliorated or corrected by administration of FIX or FVII to a subject. The present invention addresses disadvantages and/or limitations of other methods of treatment using factor IX or factor VII preparations that have a relatively short terminal half-life and/or a narrow therapeutic window.

In some embodiments, the invention provides methods for treating a subject, such as a human, with a coagulation factor-related disease, disorder or condition comprising the step of administering to the subject a therapeutically- or prophylactically-effective amount of an CFXTEN wherein said administration results in the improvement of one or more biochemical or physiological parameters or clinical endpoints associated with the coagulation factor-related disease, disorder or condition. In one embodiment of the foregoing, the CFXTEN comprises a FVII. In another embodiment of the foregoing, the CFXTEN comprises a FIX. The effective amount produces a beneficial effect in helping to treat (e.g., cure or reduce the severity) or prevent (e.g., reduce the likelihood of onset or severity) a coagulation factor-related disease, disorder or condition. As used herein, "treating" means administering a drug or a biologic (e.g., a CFXTEN) to achieve an improvement in an existing disease, disorder or condition or preventing the occurrence of a disease, disorder or condition (including prophylaxis). A therapeutically-effective amount of a CFXTEN fusion protein can be that amount of composition that, when administered as a single or as repeated doses to a subject, leads to improvements in or amelioration of the underlying disease, disorder or condition, or improvements in signs or symptoms or physiologic parameters associated with the underlying disease, disorder or condition.

Hemostasis is regulated by multiple protein factors, and such proteins, as well as analogues thereof, have found utility in the treatment of coagulation factor-related diseases, disorders and conditions. However, the use of commercially-available coagulation factors has met with less than optimal success in the management of subjects afflicted with such diseases, disorders and conditions. In particular, dose optimization and frequency of dosing is important for coagulation factors used in the treatment or prevention of bleeding episodes in coagulation factor-related diseases, disorders, or conditions, or uncontrolled bleeding in subjects not suffering from hemophilia. The fact that coagulation factors have a short half-life necessitates frequent dosing in order to achieve clinical benefit, which results in difficulties in the management of such patients.

The invention provides methods of treatment comprising administering a CFXTEN composition to a subject suffering from or at risk of developing a coagulation factor-related disease, disorder or condition, wherein the administration results in the improvement of one or more biochemical or physiological parameters or clinical endpoints associated with the condition. In one embodiment, the method of treatment comprises administering a therapeutically-effective amount of an CFXTEN composition to a subject suffering from hemophilia A wherein the administration results in the improvement of one or more biochemical or physiological parameters or clinical endpoints associated with the condition. In another embodiment, the method of treatment comprises administering a therapeutically-effective amount of an CFXTEN composition to a subject suffering from hemophilia B wherein the administration results in the improvement of one or more biochemical or physiological parameters or clinical endpoints associated with the condition. In another embodiment, the method of treatment comprises administering a therapeutically-effective amount of an CFXTEN composition to a subject suffering from factor VII deficiency wherein said administration results in the improvement of one or more biochemical or physiological parameters or clinical endpoints associated with the condition. In another embodiment, the method of treatment comprises administering a therapeutically-effective amount of an CFXTEN composition to a subject suffering from or at risk of developing uncontrolled bleeding wherein the administration results in the improvement of one or more biochemical or physiological parameters or clinical endpoints associated with the condition. In most instances, the embodiments of the disclosed method of treatments utilizing a CFXTEN comprising a FVII are compositions in which the FVII has been activated; i.e., FVIIa. However, the invention also contemplates CFXTEN compositions in which the FVII has not been activated. Because of the comparatively long-half life of CFXTEN comprising FVII, it is believed that compositions comprising the inactive form of FVII that can be activated by mammalian endogenous proteases (because they include one or more cleavage sequences; e.g., the sequences of Table 7) or the fusion protein undergoes autoactivation such that 1) a bolus quantity of activated form of FVII is available by activation via clotting proteins of the intrinsic coagulation cascade that has been initiated; or 2) a persistent quantity of activated form of FVII is available by activation via proteases that are persistently or transiently present in the circulation; e.g., MMP-12, MMP-17, etc.

Thus, the invention provides a method of treatment for a subject with a coagulation factor-related disease, disorder or conditions comprising administration of a CFXTEN comprising a FVII variant (as described above) wherein the FVII is not activated but has one or more cleavage sequences that, when cleaved by an endogenous protease, converts the FVII component to the activated form. In one embodiment of the foregoing, the method utilizes a CFXTEN composition that has a terminal half-life of at least about 12 h, or at least about 24 h, or at least about 48 h, or at least about 48 h, or at least about 96 h, or at least about 144 h, or at least about 160 h. Accordingly, the method represents a means to treat subjects with certain forms of chronic coagulopathies with what is essentially a "prodrug" form of FVII.

In some embodiments, administration of the CFXTEN to a subject results in an improvement in one or more of the biochemical, physiologic, or clinical parameters that is of greater magnitude than that of the corresponding CF component not linked to XTEN, determined using the same assay or based on a measured clinical parameter. In other embodiments, administration of the CFXTEN to a subject using a therapeutically effective dose regimen results in activity in one or more of the biochemical, physiologic, or clinical parameters that is of longer duration than the activity of the corresponding CF component not linked to XTEN, determined using that same assay or based on a measured clinical parameter. In one embodiment, the administration of a therapeutically effective amount of a CFXTEN comprising a FVII to a subject results in a reduction in prothrombin time at about 2-7 days after administration of at least about 5%, or about 10%, or about 20%, or about 30%, or about 40%, or about 50%, or about 60%, or about 70%, or more in the subject compared to the prothrombin time in a subject at a comparable time after administration of a comparable amount of FVII not linked to XTEN. In another embodiment, the administration of a CFXTEN comprising a FVII to a subject using a therapeutically effective amount results in maintenance of prothrombin times within 30% of normal in the subject for a period of time that is at least two-fold, or about three-fold, or at least about four-fold longer compared to a comparable dose regimen of FVII not linked to XTEN administered to a subject. In another embodiment, the administration of a therapeutically effective amount of a CFXTEN comprising a FIX to a subject results in a reduction in the activated partial prothrombin time at about 2-7 days after administration of at least about 5%, or about 10%, or about 20%, or about 30%, or about 40%, or about 50%, or about 60%, or about 70%, or more in the subject compared to the activated partial prothrombin time in a subject at a comparable time after administration of a comparable amount of FIX not linked to XTEN. In another embodiment, the administration of a CFXTEN comprising a FIX to a subject using a therapeutically effective amount results in maintenance of activated partial prothrombin times within 30% of normal in the subject for a period of time that is at least two-fold, or at least about three-fold, or at least about four-fold longer compared to a comparable dose regimen of FIX not linked to XTEN administered to a subject. In another embodiment, the administration of a CFXTEN comprising a FVII to a subject using a therapeutically effective amount results in maintenance of a bleeding time (in a bleeding time assay) within 30% of normal in the subject for a period of time that is at least two-fold, or about three-fold, or at least about four-fold longer compared to a comparable amount of FVII not linked to XTEN administered to a subject. In another embodiment, the administration of a CFXTEN comprising a FIX to a subject using a therapeutically effective amount results in maintenance of a bleeding time (in a bleeding time assay) within 30% of normal in the subject for a period of time that is at least two-fold, or about three-fold, or at least about four-fold longer compared to a comparable amount of FIX not linked to XTEN administered to a subject.

As a result of the enhanced PK parameters of CFXTEN, as described herein, the CF is administered using longer intervals between doses compared to the corresponding CF not linked to XTEN to prevent, treat, alleviate, reverse or ameliorate symptoms or clinical abnormalities of the coagulation factor-related disease, disorder or condition or prolong the survival of the subject being treated. In a particular application, CFXTEN comprising FVII have utility in the treatment of hemophilia A and hemophilia B.

It has been observed that FVIIa administered in high concentrations can function as a bypassing agent resulting in the activation of FX even in the absence of FIX or FVIII. In order to act as a bypassing agent FVIIa has to be dosed at concentrations that exceed the level of FVIIa in healthy people by approximately 100-fold. These levels are generally safe because FVIIa has low activity in the absence of tissue factor (TF), to which FVII binds. Tissue factor is released or presented on injured tissues which triggers clotting via the extrinsic system. The circulation half-life of FVIIa is in part limited by its inactivation by antithrombin (AT). Antithrombin can not bind to FVII but only to FVIIa. Thus, in one embodiment, the invention provides a method of treating hemophilia A or B by administering an amount of CFXTEN comprising an activated form of FVII, wherein the ability to activate FX in the circulation of a subject is maintained for a period that is at least about two-fold longer, or at least about three-fold, or at least about four-fold, or at least about five-fold, or at least about 10-fold, or at least about 20-fold longer compared to FVII not linked to XTEN and administered to a comparable subject at a comparable dose. The current invention further provides CFXTEN fusion proteins comprising FVII linked to XTEN that can not be inactivated by AT by more than about 5% prior to its activation to FVIIa-XTEN. In one embodiment, the invention provides a method of treatment comprising administering a CFXTEN with a FVII component that is not activated, wherein the CFXTEN serves as a circulating depot wherein the area under the curve for the FVII that is activated to FVIIa and not complexed with AT is at least about two-fold greater, or at least about three-fold, or at least about four-fold, or at least about five-fold, or at least about 10-fold, or at least about 20-fold greater than a FVII not linked to XTEN and administered at a comparable dose.

In some embodiments of the method of treatment, (i) a smaller molar amount of (e.g. of about two-fold less, or about three-fold less, or about four-fold less, or about five-fold less, or about six-fold less, or about eight-fold less, or about 10-fold-less or greater) the fusion protein is administered in comparison to the corresponding CF not linked to the XTEN under an otherwise same dose regimen, and the fusion protein achieves a comparable therapeutic effect as the corresponding CF not linked to the XTEN; (ii) the fusion protein is administered less frequently (e.g., every two days, about every seven days, about every 14 days, about every 21 days, or about, monthly) in comparison to the corresponding CF not linked to the XTEN under an otherwise same dose amount, and the fusion protein achieves a comparable therapeutic effect as the corresponding CF not linked to the XTEN; or (iii) an accumulative smaller molar amount (e.g. about 5%, or about 10%, or about 20%, or about 40%, or about 50%, or about 60%, or about 70%, or about 80%, or about 90% less) of the fusion protein is administered in comparison to the corresponding CF not linked to the XTEN under the otherwise same dose regimen the fusion protein achieves a comparable therapeutic effect as the corresponding CF not linked to the XTEN. The accumulative smaller molar amount is measure for a period of at least about one week, or about 14 days, or about 21 days, or about one month. The therapeutic effect can be determined by any of the measured parameters or clinical endpoints described herein.

The methods of the invention includes administration of consecutive doses of a therapeutically effective amount of the CFXTEN for a period of time sufficient to achieve and/or maintain the desired parameter or clinical effect, and such consecutive doses of a therapeutically effective amount establishes the therapeutically effective dose regimen for the CFXTEN, i.e., the schedule for consecutively administered doses of the fusion protein composition, wherein the doses are given in therapeutically effective amounts to result in a sustained beneficial effect on any clinical sign or symptom, aspect, measured parameter or characteristic of a coagulation factor-related disease state or condition, including, but not limited to, those described herein. In one embodiment, the method comprises administering a therapeutically-effective amount of a pharmaceutical composition comprising a CFXTEN fusion protein composition comprising a CF linked to an XTEN sequence(s) and at least one pharmaceutically acceptable carrier to a subject in need thereof that results in greater improvement in at least one parameter, physiologic condition, or clinical outcome mediated by the CF component(s) (non-limiting examples of which are described above) compared to the effect mediated by administration of a pharmaceutical composition comprising a CF not linked to XTEN and administered at a comparable dose. In one embodiment, the pharmaceutical composition is administered at a therapeutically effective dose. In another embodiment, the pharmaceutical composition is administered using multiple consecutive doses using a therapeutically effective dose regimen (as defined herein) for the length of the dosing period.

A therapeutically effective amount of the CFXTEN varies according to factors such as the disease state, age, sex, and weight of the individual, and the ability of the administered fusion protein to elicit a desired response in the individual. A therapeutically effective amount is also one in which any toxic or detrimental effects of the CFXTEN are outweighed by the therapeutically beneficial effects. A prophylactically effective amount refers to an amount of CFXTEN required for the period of time necessary to achieve the desired prophylactic result; e.g., delayed onset of a bleeding episode. In the methods of treatment, the dose of the CFXTEN that is administered to a subject ranges from about 0.5 mg to 1000 mg/dose, or from about 1 mg to 400 mg/dose, or from about 10 mg to about 300 mg/dose for a 70 kg subject as loading and maintenance doses, depending on the weight of the subject and the severity of the condition.

The method of treatment comprises administration of a CFXTEN using a therapeutically effective dose regimen to effect improvements in one or more parameters associated with coagulation factor diseases, disorders or conditions. In some embodiments, administration of the CFXTEN to a subject results in an improvement in one or more of the biochemical, physiologic, or clinical parameters that is of greater magnitude than that of the corresponding CF component not linked to XTEN, determined using the same assay or based on a measured clinical parameter. In other embodiments, administration of the CFXTEN to a subject using a therapeutically effective dose regimen results in activity in one or more of the biochemical, physiologic, or clinical parameters that is of longer duration than the activity of one of the single CF components not linked to XTEN, determined using that same assay or based on a measured clinical parameter. In one embodiment of the foregoing, the administration of the CFXTEN to a subject using a therapeutically effective dose regimen results in an improvement in prothrombin time or activated partial thromboplastin time of at least about 10%, or about 20%, or about 30%, or about 40%, or about 50%, or about 60%, or about 70%, or about 80%, or about 90%, or about 100% or more in the subject compared to a comparable dose of CF not linked to XTEN administered to a subject. In another embodiment of the foregoing, the administration of the CFXTEN to a subject using a therapeutically effective dose regimen results in decreased instances of bleeding in the subject of at least about 10%, or about 20%, or about 30%, or about 40%, or about 50% or more compared to a comparable dose regimen of CF not linked to XTEN administered to a subject.

The invention further contemplates that CFXTEN used in accordance with the methods provided herein is administered in conjunction with other treatment methods and compositions (e.g., other coagulation proteins) useful for treating coagulation factor-related diseases, disorders, and conditions, or conditions for which coagulation factor is adjunctive therapy; e.g., bleeding episodes due to injury or surgery.

In another aspect, the invention provides a method of designing the CFXTEN compositions with desired pharmacologic or pharmaceutical properties. The CFXTEN fusion proteins are designed and prepared with various objectives in mind (compared to the CF components not linked to the fusion protein), including improving the therapeutic efficacy for the treatment of coagulation factor-related diseases, disorders, and conditions, enhancing the pharmacokinetic characteristics of the fusion proteins compared to the CF, lowering the dose or frequency of dosing required to achieve a pharmacologic effect, enhancing the pharmaceutical properties, and to enhance the ability of the CF components to remain within the therapeutic window for an extended period of time.

Figure 31:
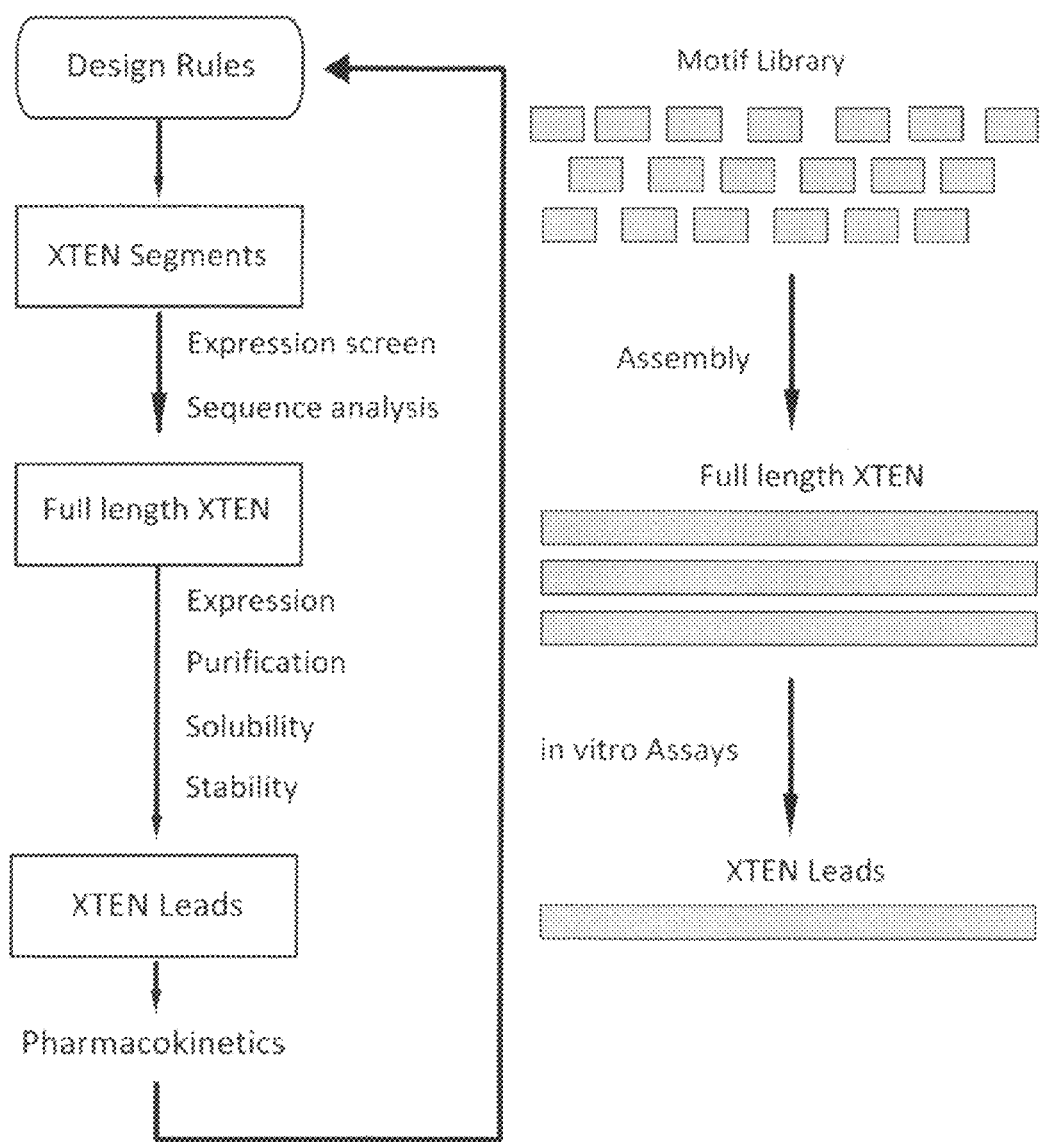
FIG. 31 is a schematic flowchart of representative steps in the assembly, production and the evaluation of a XTEN.
Figure 32:
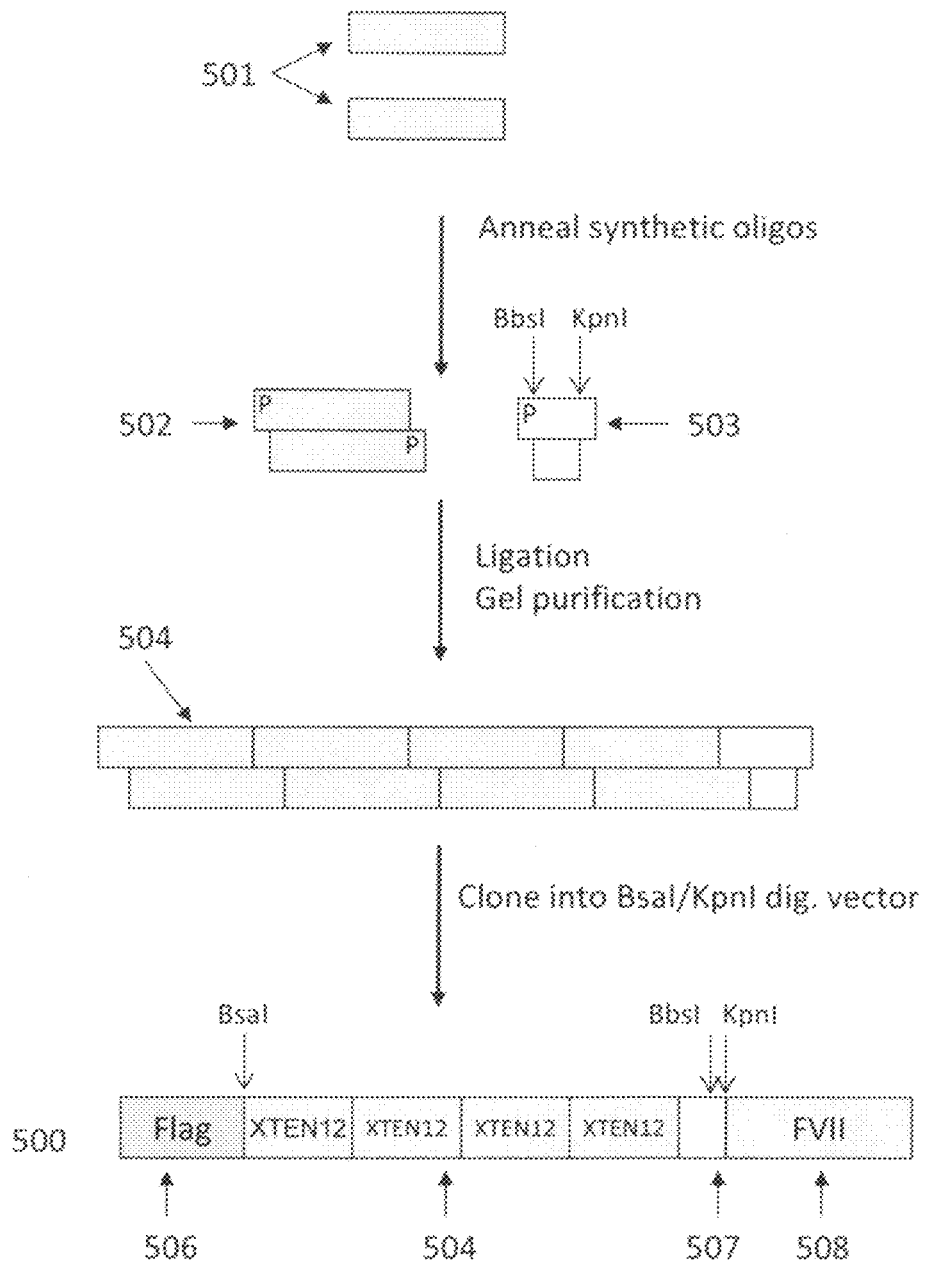
FIG. 32 is a schematic flowchart of representative steps in the assembly of a CFXTEN polynucleotide construct encoding a fusion protein. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. In this case, the vector encodes an optional Flag sequence 506 followed by a stopper sequence that is flanked by BsaI, BbsI, and KpnI sites 507 and an FVII gene 508, resulting in the gene 500 encoding an XTEN-FVII fusion protein.
Figure 33:
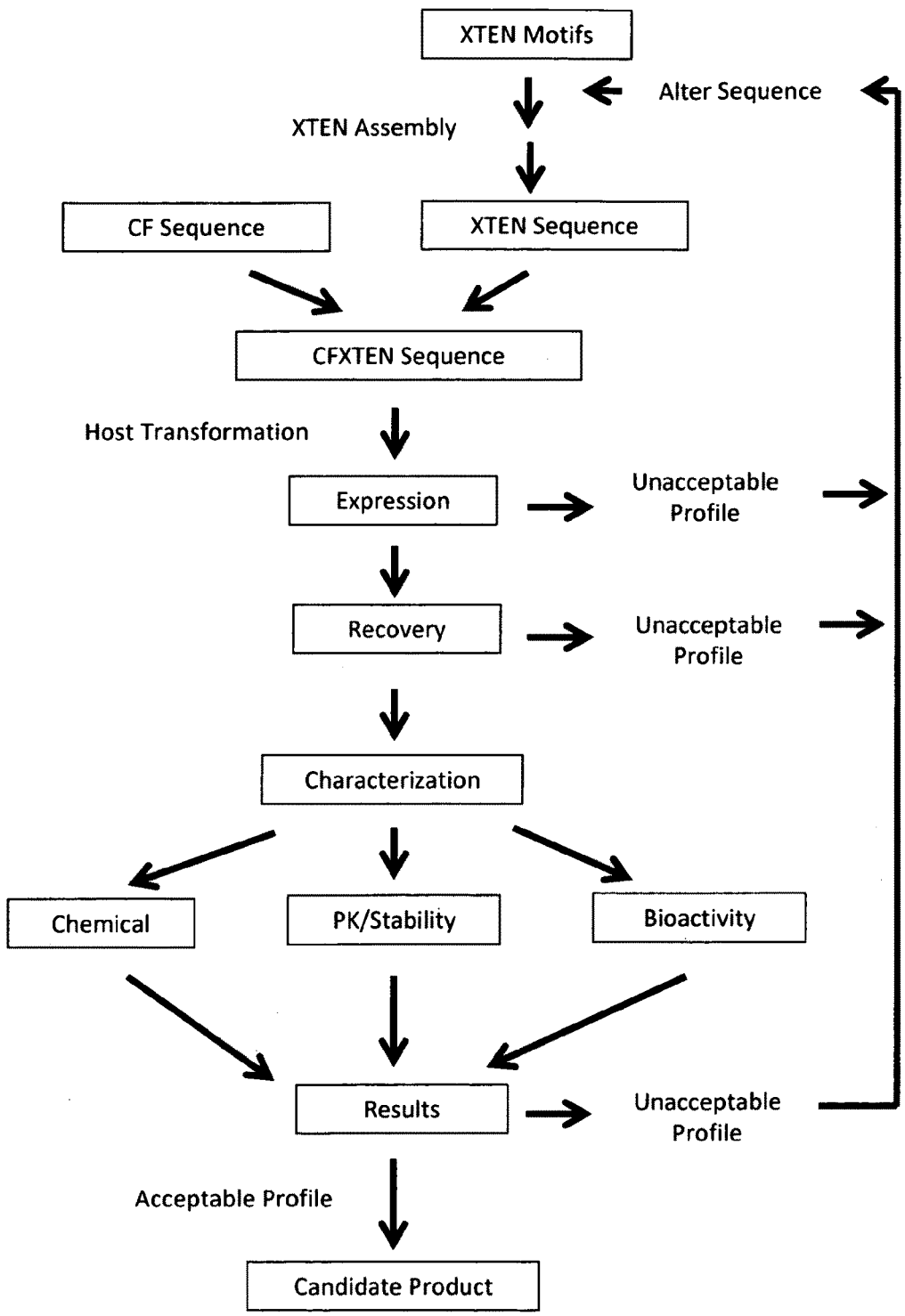
FIG. 33 is a schematic flowchart of representative steps in the assembly of a gene encoding fusion protein comprising a CF and XTEN, its expression and recovery as a fusion protein, and its evaluation as a candidate CFXTEN product.
Figure 34:
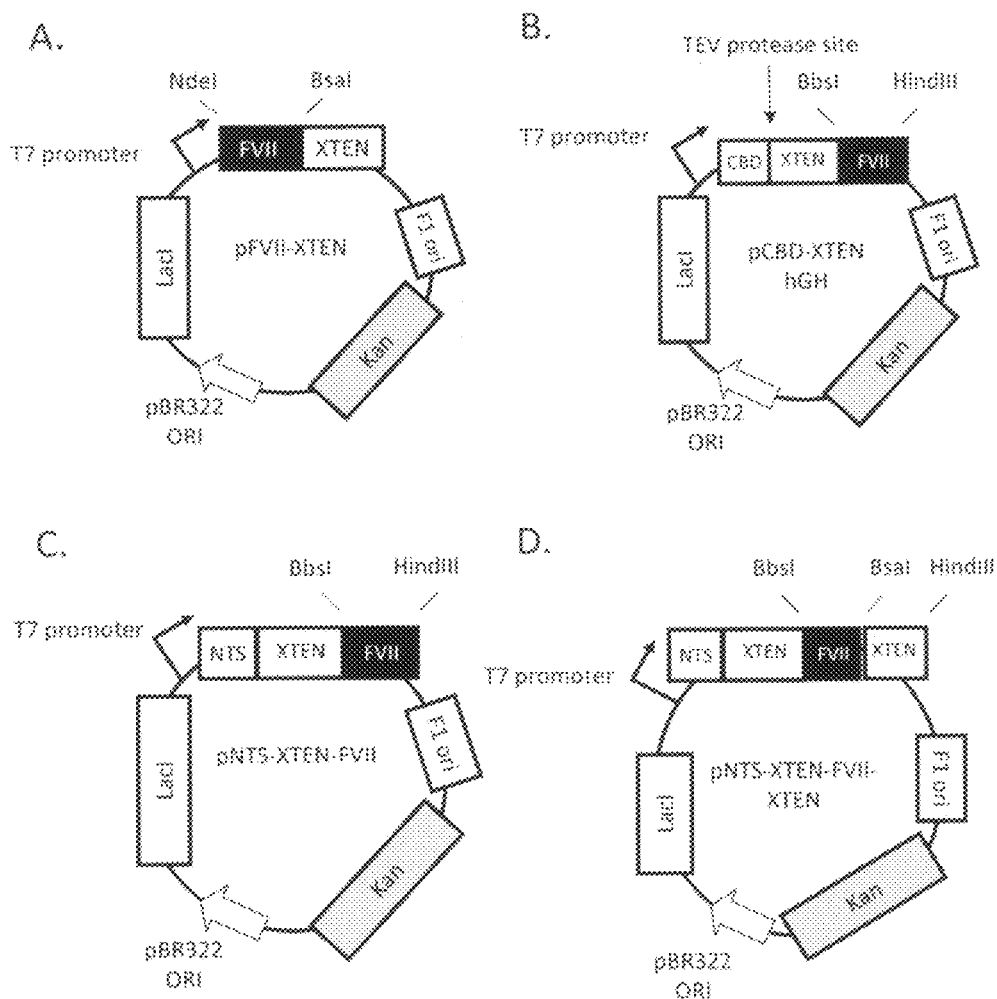
FIG. 34 is a schematic representation of the design of CFXTEN expression vectors with different processing strategies.

In general, the steps in the design and production of the fusion proteins and the inventive compositions, as illustrated in FIGS. 31-33, include: (1) the selection of CFs (e.g., native proteins, sequences of Tables 1 and 2, analogs or derivatives with activity) to treat the particular disease, disorder or condition; (2) selecting the XTEN that will confer the desired PK and physicochemical characteristics on the resulting CFXTEN (e.g., the administration of the CFXTEN composition to a subject results in the fusion protein being maintained within the therapeutic window for a greater period compared to CF not linked to XTEN); (3) establishing a desired N- to C-terminus configuration of the CFXTEN to achieve the desired efficacy or PK parameters; (4) establishing the design of the expression vector encoding the configured CFXTEN; (5) transforming a suitable host with the expression vector; and (6) expression and recovery of the resultant fusion protein. For those CFXTEN for which an increase in half-life (greater than 24 h) or an increased period of time spent within a therapeutic window is desired, the XTEN chosen for incorporation generally has at least about 100, or about 144, or about 288, or about 432, or about 576, or about 864, or about 875, or about 912, or about 923 amino acid residues where a single XTEN is to be incorporated into the CFXTEN. In another embodiment, the CFXTEN comprises a first XTEN of the foregoing lengths, and at least a second XTEN of about 36, or about 72, or about 144, or about 288, or about 576, or about 864, or about 875, or about 912, or about 923 amino acid residues.

In other embodiments, where an increase in half-life is not required, but an increase in a pharmaceutical property (e.g., solubility) is desired, a CFXTEN is designed to include XTEN of shorter lengths. In some embodiments of the foregoing, the CFXTEN comprises a CF linked to an XTEN having at least about 24, or about 36, or about 48, or about 60, or about 72, or about 84, or about 96 amino acid residues, in which the solubility of the fusion protein under physiologic conditions is at least three-fold greater than the corresponding CF not linked to XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than CF not linked to XTEN. In one embodiment of the foregoing, the CF is factor IX. In another embodiment, the CF is factor VII. In another embodiment, the XTEN is a sequence with at least about 80%, or about 90%, or about 95% sequence identity compared to a sequence from Tables 4, and 9-13.

In another aspect, the invention provides methods of making CFXTEN compositions to improve ease of manufacture, result in increased stability, increased water solubility, and/or ease of formulation, as compared to the native CF. In one embodiment, the invention includes a method of increasing the water solubility of a CF comprising the step of linking the CF to one or more XTEN such that a higher concentration in soluble form of the resulting CFXTEN can be achieved, under physiologic conditions, compared to the CF in an un-fused state. Factors that contribute to the property of XTEN to confer increased water solubility of CFs when incorporated into a fusion protein include the high solubility of the XTEN fusion partner and the low degree of self-aggregation between molecules of XTEN in solution. In some embodiments, the method results in a CFXTEN fusion protein wherein the water solubility is at least about 20%, or at least about 30% greater, or at least about 50% greater, or at least about 75% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater, or at least about 4000% greater, or at least about 6000% greater under physiologic conditions, compared to the un-fused CF. In one embodiment, the XTEN of the CFXTEN fusion protein is a sequence with at least about 80%, or about 90%, or about 95% sequence identity compared to a sequence from Tables 4, and 9-13.

In another embodiment, the invention includes a method of increasing the shelf-life of a CF comprising the step of linking the CF with one or more XTEN selected such that the shelf-life of the resulting CFXTEN is extended compared to the CF in an un-fused state. As used herein, shelf-life refers to the period of time over which the functional activity of a CF or CFXTEN that is in solution or in some other storage formulation remains stable without undue loss of activity. As used herein, "functional activity" refers to a pharmacologic effect or biological activity, such as the ability to bind a receptor or ligand, or substrate, or an enzymatic activity, or to display one or more known functional activities associated with a CF, as known in the art. A CF that degrades or aggregates generally has reduced functional activity or reduced bioavailability compared to one that remains in solution. Factors that contribute to the ability of the method to extend the shelf life of CFs when incorporated into a fusion protein include increased water solubility, reduced self-aggregation in solution, and increased heat stability of the XTEN fusion partner. In particular, the low tendency of XTEN to aggregate facilitates methods of formulating pharmaceutical preparations containing higher drug concentrations of CFs, and the heat-stability of XTEN contributes to the property of CFXTEN fusion proteins to remain soluble and functionally active for extended periods. In one embodiment, the method results in CFXTEN fusion proteins with "prolonged" or "extended" shelf-life that exhibit greater activity relative to a standard that has been subjected to the same storage and handling conditions. The standard may be the un-fused full-length CF. In one embodiment, the method includes the step of formulating the isolated CFXTEN with one or more pharmaceutically acceptable excipients that enhance the ability of the XTEN to retain its unstructured conformation and for the CFXTEN to remain soluble in the formulation for a time that is greater than that of the corresponding un-fused CF. In one embodiment, the method comprises linking a CF to one or more XTEN selected from Tables 4 and 9-13 to create a CFXTEN fusion protein results in a solution that retains greater than about 100% of the functional activity, or greater than about 105%, 110%, 120%, 130%, 150% or 200% of the functional activity of a standard when compared at a given time point and when subjected to the same storage and handling conditions as the standard, thereby increasing its shelf-life.

Shelf-life may also be assessed in terms of functional activity remaining after storage, normalized to functional activity when storage began. CFXTEN fusion proteins of the invention with prolonged or extended shelf-life as exhibited by prolonged or extended functional activity retain about 50% more functional activity, or about 60%, 70%, 80%, or 90% more of the functional activity of the equivalent CF not linked to XTEN when subjected to the same conditions for the same period of time. For example, a CFXTEN fusion protein of the invention comprising coagulation factor fused to one or more XTEN sequences selected from Tables 4 and 9-13 retains about 80% or more of its original activity in solution for periods of up to 2 weeks, or 4 weeks, or 6 weeks or longer under various temperature conditions. In some embodiments, the CFXTEN retains at least about 50%, or about 60%, or at least about 70%, or at least about 80%, and most preferably at least about 90% or more of its original activity in solution when heated at 80° C. for 10 min. In other embodiments, the CFXTEN retains at least about 50%, preferably at least about 60%, or at least about 70%, or at least about 80%, or alternatively at least about 90% or more of its original activity in solution when heated or maintained at 37° C. for about 7 days. In another embodiment, CFXTEN fusion protein retains at least about 80% or more of its functional activity after exposure to a temperature of about 30° C. to about 70° C. over a period of time of about one hour to about 18 hours. In the foregoing embodiments hereinabove described in this paragraph, the retained activity of the CFXTEN is at least about two-fold, or at least about three-fold, or at least about four-fold, or at least about five-fold, or at least about six-fold greater at a given time point than that of the corresponding CF not linked to the fusion protein.

VII). The Nucleic Acids of the Invention

The present invention provides isolated polynucleic acids encoding CFXTEN chimeric fusion proteins and sequences complementary to polynucleic acid molecules encoding CFXTEN chimeric fusion proteins, including homologous variants thereof. In another aspect, the invention encompasses methods to produce polynucleic acids encoding CFXTEN chimeric fusion proteins and sequences complementary to polynucleic acid molecules encoding CFXTEN chimeric fusion protein, including homologous variants thereof. In general, and as illustrated in FIGS. 31-33, the methods of producing a polynucleotide sequence coding for a CFXTEN fusion protein and expressing the resulting gene product include assembling nucleotides encoding CF and XTEN, ligating the components in frame, incorporating the encoding gene into an expression vector appropriate for a host cell, transforming the appropriate host cell with the expression vector, and culturing the host cell under conditions causing or permitting the fusion protein to be expressed in the transformed host cell, thereby producing the biologically-active CFXTEN polypeptide, which is recovered as an isolated fusion protein by standard protein purification methods known in the art. Standard recombinant techniques in molecular biology are used to make the polynucleotides and expression vectors of the present invention.

In accordance with the invention, nucleic acid sequences that encode CFXTEN (or its complement) is used to generate recombinant DNA molecules that direct the expression of CFXTEN fusion proteins in appropriate host cells. Several cloning strategies are suitable for performing the present invention, many of which is used to generate a construct that comprises a gene coding for a fusion protein of the CFXTEN composition of the present invention, or its complement. In some embodiments, the cloning strategy is used to create a gene that encodes a monomeric CFXTEN that comprises at least a first CF and at least a first XTEN polypeptide, or their complement. In one embodiment of the foregoing, the gene comprises a sequence encoding a CF or sequence variant. In other embodiments, the cloning strategy is used to create a gene that encodes a monomeric CFXTEN that comprises nucleotides encoding at least a first molecule of CF or its complement and a first and at least a second XTEN or their complement that is used to transform a host cell for expression of the fusion protein of the CFXTEN composition. In the foregoing embodiments hereinabove described in this paragraph, the genes can further comprise nucleotides encoding spacer sequences that also encode cleavage sequence(s).

In designing a desired XTEN sequences, it was discovered that the non-repetitive nature of the XTEN of the inventive compositions is achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 31 and 32 and Examples). Thus, while the XTEN(s) of the expressed fusion protein may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to CFXTEN fusion protein. DNA encoding the CF of the compositions is obtained from a cDNA library prepared using standard methods from tissue or isolated cells believed to possess CF mRNA and to express it at a detectable level. Libraries is screened with probes containing, for example, about 20 to 100 bases designed to identify the CF gene of interest by hybridization using conventional molecular biology techniques. The best candidates for probes are those that represent sequences that are highly homologous for coagulation factor, and should be of sufficient length and sufficiently unambiguous that false positives are minimized, but may be degenerate at one or more positions. If necessary, the coding sequence can be obtained using conventional primer extension procedures as described in Sambrook, et al., supra, to detect precursors and processing intermediates of mRNA that may not have been reverse-transcribed into cDNA. One can then use polymerase chain reaction (PCR) methodology to amplify the target DNA or RNA coding sequence to obtain sufficient material for the preparation of the CFXTEN constructs containing the CF gene(s). Assays can then be conducted to confirm that hybridizing full-length genes are the desired CF gene(s). By these conventional methods, DNA can be conveniently obtained from a cDNA library prepared from such sources. The CF encoding gene(s) is also be obtained from a genomic library or created by standard synthetic procedures known in the art (e.g., automated nucleic acid synthesis using, for example one of the methods described in Engels et al. (Agnew. Chem. Int. Ed. Engl., 28:716-734 1989)), using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the CF encoding gene encodes a protein from any one of Table 1 or Table 2, or a fragment or variant thereof.

A gene or polynucleotide encoding the CF portion of the subject CFXTEN protein, in the case of an expressed fusion protein that comprises a single CF is then be cloned into a construct, which is a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the CF gene by cloning it into the construct adjacent and in frame with the gene(s) coding for the CF. This second step occurs through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two or more codon-optimized oligonucleotides encoding XTEN motif or segment sequences of about 9 to 14 amino acids, or about 12 to 20 amino acids, or about 18 to 36 amino acids, or about 48 to about 144 amino acids, or about 144 to about 288 or longer, or any combination of the foregoing ranges of motif or segment lengths.

Alternatively, the disclosed method is used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit being used, which can reduce recombination and increase stability of the encoding gene in the transformed host. Genes encoding XTEN with non-repetitive sequences is assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as illustrated in FIGS. 31 and 32. This can be a pure codon library such that each library member has the same amino acid sequence but many different coding sequences are possible. Such libraries can be assembled from partially randomized oligonucleotides and used to generate large libraries of XTEN segments comprising the sequence motifs. The randomization scheme can be optimized to control amino acid choices for each position as well as codon usage. Exemplary methods to achieve the foregoing are disclosed in the Examples.

Polynucleotide Libraries

In another aspect, the invention provides libraries of polynucleotides that encode XTEN sequences that are used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes, e.g., 12 amino acid motifs can be dimerized and/or ligated into a library of polynucleotides that encode 36 amino acids. Libraries encoding motifs of different lengths; e.g., 9-14 amino acid motifs leading to libraries encoding 27 to 42 amino acids are contemplated by the invention. In turn, the library of polynucleotides that encode 27 to 42 amino acids, and preferably 36 amino acids (as described in the Examples) can be serially dimerized into a library containing successively longer lengths of polynucleotides that encode XTEN sequences of a desired length for incorporation into the gene encoding the CFXTEN fusion protein, as disclosed herein. In some embodiments, libraries are assembled of polynucleotides that encode amino acids that are limited to specific sequence XTEN families; e.g., AD, AE, AF, AG, AM, or AQ sequences of Table 3. In other embodiments, libraries comprise sequences that encode two or more of the motif family sequences from Table 3. The names and sequences of representative, non-limiting polynucleotide sequences of libraries that encode 36mers are presented in Tables 9-12, and the methods used to create them are described more fully in the respective Examples. In other embodiments, libraries that encode XTEN are constructed from segments of polynucleotide codons linked in a randomized sequence that encode amino acids wherein at least about 80%, or at least about 90%, or at least about 91%, or at least about 92%, or at least about 93%, or at least about 94%, or at least about 95%, or at least about 97%, or at least about 98%, or at least about 99% of the codons are selected from the group consisting of codons for glycine (G), alanine (A), serine (S), threonine (T), glutamate (E) and proline (P) amino acids. The libraries can be used, in turn, for serial dimerization or ligation to achieve polynucleotide sequence libraries that encode XTEN sequences, for example, of 48, 72, 144, 288, 576, 864, 875, 912, 923, 1318 amino acids, or up to a total length of about 3000 amino acids, as well as intermediate lengths, in which the encoded XTEN can have one or more of the properties disclosed herein, when expressed as a component of a CFXTEN fusion protein. In some cases, the polynucleotide library sequences may also include additional bases used as "sequencing islands," described more fully below.

FIG. 5 is a schematic flowchart of representative, non-limiting steps in the assembly of a XTEN polynucleotide construct and a CFXTEN polynucleotide construct in the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector optionally encodes a Flag sequence 506 followed by a stuffer sequence that is flanked by BsaI, BbsI, and KpnI sites 507 and, in this case, a single CF gene (encoding FIX in this example) 508, resulting in the gene encoding a CFXTEN comprising a single CF 500. A non-exhaustive list of the XTEN names for polynucleotides encoding XTEN and precursor sequences is provided in Table 8.

TABLE 8

DNA sequences of XTEN and precursor sequences

| XTEN Name | SEQ ID NO: | DNA Nucleotide Sequence |
|---|---|---|
| AE48 | 111 | ATGGCTGAACCTGCTGGCTCTCCAACCTCCACTGAGGAAGGTACCCCGGGTAGC GGTACTGCTTCTTCCTCTCCAGGTAGCTCTACCCCTTCTGGTGCAACCGGCTCTC CAGGTGCTTCTCCGGGCACCAGCTCTACCGGTTCT |
| AM48 | 112 | ATGGCTGAACCTGCTGGCTCTCCAACCTCCACTGAGGAAGGTGCATCCCCGGGC ACCAGCTCTACCGGTTCTCCAGGTAGCTCTACCCCGTCTGGTGCTACCGGCTCTC CAGGTAGCTCTACCCCGTCTGGTGCTACTGGCTCT |
| AE144 | 113 | GGTAGCGAACCGGCAACTTCCGGCTCTGAAACCCCAGGTACTTCTGAAAGCGCT ACTCCTGAGTCTGGCCCAGGTAGCGAACCTGCTACCTCTGGCTCTGAAACCCCA GGTAGCCCGGCAGGCTCTCCGACTTCCACCGAGGAAGGTACCTCTACTGAACCT TCTGAGGGTAGCGCTCCAGGTAGCGAACCGGCAACCTCTGGCTCTGAAACCCCA GGTAGCGAACCTGCTACCTCCGGCTCTGAAACTCCAGGTAGCGAACCGGCTACT TCCGGTTCTGAAACTCCAGGTACCTCTACCGAACCTTCCGAAGGCAGCGCACCA GGTACTTCTGAAAGCGCAACCCCTGAATCCGGTCCAGGTAGCGAACCGGCTACT TCTGGCTCTGAGACTCCAGGTACTTCTACCGAACCGTCCGAAGGTAGCGCACCA |
| AF144 | 114 | GGTACTTCTACTCCGGAAAGCGGTTCCGCATCTCCAGGTACTTCTCCTAGCGGTG AATCTTCTACTGCTCCAGGTACCTCTCCTAGCGGCGAATCTTCTACTGCTCCAGG TTCTACCAGCTCTACCGCTGAATCTCCTGGCCCAGGTTCTACCAGCGAATCCCCG TCTGGCACCGCACCAGGTTCTACTAGCTCTACCGCAGAATCTCCGGGTCCAGGT ACTTCCCCTAGCGGTGAATCTTCTACTGCTCCAGGTACCTCTACTCCGGAAAGCG GCTCCGCATCTCCAGGTTCTACTAGCTCTACTGCTGAATCTCCTGGTCCAGGTAC CTCCCCTAGCGGCGAATCTTCTACTGCTCCAGGTACCTCTCCTAGCGGCGAATCT TCTACCGCTCCAGGTACCTCCCCTAGCGGTGAATCTTCTACCGCACCA |

TABLE 8-continued

DNA sequences of XTEN and precursor sequences

| XTEN Name | SEQ ID NO: | DNA Nucleotide Sequence |
|---|---|---|
| AE288 | 115 | GGTACCTCTGAAAGCGCAACTCCTGAGTCTGGCCCAGGTAGCGAACCTGCTACC<br>TCCGGCTCTGAGACTCCAGGTACCTCTGAAAGCGCAACCCCGGAATCTGGTCCA<br>GGTAGCGAACCTGCAACCTCTGGCTCTGAAACCCCAGGTACCTCTGAAAGCGCT<br>ACTCCTGAATCTGGCCCAGGTACTTCTACTGAACCGTCCGAGGGCAGCGCACCA<br>GGTAGCCCTGCTGGCTCTCCAACCTCCACCGAAGAAGGTACCTCTGAAAGCGCA<br>ACCCCTGAATCCGGCCCAGGTAGCGAACCGGCAACCTCCGGTTCTGAAACCCCA<br>GGTACTTCTGAAAGCGCTACTCCTGAGTCCGGCCCAGGTAGCCCGGCTGGCTCT<br>CCGACTTCCACCGAGGAAGGTAGCCCGGCTGGCTCTCCAACTTCTACTGAAGAA<br>GGTACTTCTACCGAACCTTCCGAGGGCAGCGCACCAGGTACTTCTGAAAGCGCT<br>ACCCCTGAGTCCGCCCAGGTACTTCTGAAAGCGCTACTCCTGAATCCGGTCCA<br>GGTACTTCTGAAAGCGCTACCCCGGAATCTGGCCCAGGTAGCGAACCGGCTACT<br>TCTGGTTCTGAAACCCCAGGTAGCGAACCGGCTACCTCCGGTTCTGAAACTCCA<br>GGTAGCCCAGCAGGCTCTCCGACTTCCACTGAGGAAGGTACTTCTACTGAACCT<br>TCCGAAGGCAGCGCACCAGGTACCTCTACTGAACCTTCTGAGGGCAGCGCTCCA<br>GGTAGCGAACCTGCAACCTCTGGCTCTGAAACCCCAGGTACCTCTGAAAGCGCT<br>ACTCCTGAATCTGGCCCAGGTACTTCTACTGAACCGTCCGAGGGCAGCGCACCA |
| AE576 | 116 | GGTAGCCCGGCTGGCTCTCCTACCTCTACTGAGGAAGGTACTTCTGAAAGCGCT<br>ACTCCTGAGTCTGGTCCAGGTACCTCTACTGAACCGTCCGAAGGTAGCGCTCCA<br>GGTAGCCCAGCAGGCTCTCCGACTTCCACTGAGGAAGGTACTTCTACTGAACCT<br>TCCGAAGGCAGCGCACCAGGTACCTCTACTGAACCTTCTGAGGGCAGCGCTCCA<br>GGTACTTCTGAAAGCGCTACCCCGGAATCTGGCCCAGGTAGCGAACCGGCTACT<br>TCTGGTTCTGAAACCCCAGGTAGCGAACCGGCTACCTCCGGTTCTGAAACTCCA<br>GGTAGCCCGGCAGGCTCTCCGACCTCTACTGAGGAAGGTACTTCTGAAAGCGCA<br>ACCCCGGAGTCCGGCCCAGGTACCTCTACCGAACCGTCTGAGGGCAGCGCACCA<br>GGTACTTCTACCGAACCGTCCGAGGGTAGCGCACCAGGTAGCCCAGCAGGTTCT<br>CCTACCTCCACCGAGGAAGGTACTTCTACCGAACCGTCCGAGGGTAGCGCACCA<br>GGTACCTCTACTGAACCTTCTGAGGGCAGCGCTCCAGGTACTTCTGAAAGCGCT<br>ACCCCGGAGTCCGGTCCAGGTACTTCTACTGAACCGTCCGAAGGTAGCGCACCA<br>GGTACTTCTGAAAGCGCAACCCCTGAATCCGGTCCAGGTAGCGAACCGGCTACT<br>TCTGGCTCTGAGACTCCAGGTACTTCTACCGAACCGTCCGAAGGTAGCGCACCA<br>GGTACTTCTACTGAACCGTCTGAAGGTAGCGCACCAGGTACTTCTGAAAGCGCA<br>ACCCCGGAATCCGGCCCAGGTACCTCTGAAAGCGCAACCCCGGAGTCCGGCCC<br>AGGTAGCCCTGCTGGCTCTCCAACCTCCACCGAAGAAGGTACCTCTGAAAGCGC<br>AACCCCTGAATCCGGCCCAGGTAGCGAACCGGCAACCTCCGGTTCTGAAACCCC<br>AGGTACCTCTGAAAGCGCTACTCCGGAGTCTGGCCCAGGTACCTCTACTGAACC<br>GTCTGAGGGTAGCGCTCCAGGTACTTCTACTGAACCGTCCGAAGGTAGCGCACC<br>AGGTACTTCTACCGAACCGTCCGAAGGCAGCGCTCCAGGTACCTCTACTGAACC<br>TTCCGAGGGCAGCGCTCCAGGTACCTCTACCGAACCTTCTGAAGGTAGCGCACC<br>AGGTACTTCTACCGAACCGTCCGAGGGTAGCGCACCAGGTAGCCCAGCAGGTTC<br>TCCTACCTCCACCGAGGAAGGTACTTCTACCGAACCGTCCGAGGGTAGCGCACC<br>AGGTACCTCTGAAAGCGCAACTCCTGAGTCTGGCCCAGGTAGCGAACCTGCTAC<br>CTCCGGCTCTGAGACTCCAGGTACCTCTGAAAGCGCAACCCCGGAATCTGGTCC<br>AGGTAGCGAACCTGCAACCTCTGGCTCTGAAACCCCAGGTACCTCTGAAAGCGC<br>TACTCCTGAATCTGGCCCAGGTACTTCTACTGAACCGTCCGAGGGCAGCGCACC<br>AGGTACTTCTGAAAGCGCTACTCCTGAGTCCGGCCCAGGTAGCCCGGCTGGCTC<br>TCCGACTTCCACCGAGGAAGGTAGCCCGGCTGGCTCTCCAACTTCTACTGAAGA<br>AGGTAGCCCGGCAGGCTCTCCGACCTCTACTGAGGAAGGTACTTCTGAAAGCGC<br>AACCCCGGAGTCCGGCCCAGGTACCTCTACCGAACCGTCTGAGGGCAGCGCACCA |
| AF576 | 117 | GGTTCTACTAGCTCTACCGCTGAATCTCCTGGCCCAGGTTCCACTAGCTCTACCG<br>CAGAATCTCCGGGCCCAGGTTCTACTAGCGAATCCCCTTCTGGTACCGCTCCAG<br>GTTCTACTAGCTCTACCGCTGAATCTCCGGGTCCAGGTTCTACCAGCTCTACTGC<br>AGAATCTCCTGGCCCAGGTACTTCTACTCCGGAAAGCGGTTCCGCTTCTCCAGGT<br>TCTACCAGCGAATCTCCTTCTGGCACCGCTCCAGGTACCTCTCCTAGCGGCGAAT<br>CTTCTACCGCTCCAGGTTCTACTAGCGAATCTCCTTCTGGCACTGCACCAGGTTC<br>TACCAGCGAATCTCCTTCTGGCACCGCTCCAGGTACCTCTCCTAGCGGCGAATCT<br>TCTACCGCTCCAGGTTCTACTAGCGAATCTCCTTCTGGCACTGCACCAGGTTCTA<br>CCAGCGAATCTCCTTCTGGCACCGCTCCAGGTACCTCTCCTAGCGGCGAATCTTC<br>TACCGCTCCAGGTTCTACTAGCGAATCTCCTTCTGGCACTGCACCAGGTTCTACT<br>AGCGAATCTCCTTCTGGCACTGCACCAGGTTCTACCAGCGAATCTCCGTCTGGC<br>ACTGCACCAGGTACCTCTACCCCTGAAAGCGGTTCCGCTTCTCCAGGTTCTACTA<br>GCGAATCTCCTTCTGGTACCGCTCCAGGTACTTCTACCCCTGAAAGCGGCTCCGC<br>TTCTCCAGGTTCCACTAGCTCTACCGCTGAATCTCCGGGTCCAGGTTCTACTAGC<br>TCTACTGCAGAATCTCCTGGCCCAGGTACCTCTACTCCGGAAAGCGGCTCTGCA<br>TCTCCAGGTACTTCTACCCCTGAAAGCGGTTCTGCATCTCCAGGTTCTACTAGCG<br>AATCCCGTCTGGTACCGCACCAGGTACTTCTACCCCGGAAAGCGGCTCTGCTT<br>CTCCAGGTACTTCTACCCCGGAAAGCGGCTCCGCATCTCCAGGTTCTACTAGCG<br>AATCTCCTTCTGGTACCGCTCCAGGTTCTACCAGCGAATCCCCGTCTGGTACTGC<br>TCCAGGTTCTACCAGCGAATCTCCTTCTGGTACTGCACCAGGTTCTACTAGCTCT<br>ACTGCAGAATCTCCTGGCCCAGGTACCTCTACTCCGGAAAGCGGCTCTGCATCT<br>CCAGGTACTTCTACCCCTGAAAGCGGTTCTGCATCTCCAGGTTCTACTAGCGAAT<br>CTCCTTCTGGCACTGCACCAGGTTCTACCAGCGAATCTCCGTCTGGCACTGCACC<br>AGGTACCTCTACCCCTGAAAGCGGTTCCGCTTCTCCAGGTTCTACTAGCGAATCT |

TABLE 8-continued

DNA sequences of XTEN and precursor sequences

| XTEN Name | SEQ ID NO: | DNA Nucleotide Sequence |
|---|---|---|
| | | CCTTCTGGCACTGCACCAGGTTCTACCAGCGAATCTCCGTCTGGCACTGCACCA
GGTACCTCTACCCCTGAAAGCGGTTCCGCTTCTCCAGGTACTTCTCCGAGCGGTG
AATCTTCTACCGCACCAGGTTCTACTAGCTCTACCGCTGAATCTCCGGGCCCAGG
TACTTCTCCGAGCGGTGAATCTTCTACTGCTCCAGGTTCCACTAGCTCTACTGCT
GAATCCTGGCCCAGGTACTTCTACTCCGGAAAGCGGTTCCGCTTCTCCAGGTT
CTACTAGCGAATCTCCGTCTGGCACCGCACCAGGTTCTACTAGCTCTACTGCAG
AATCTCCTGGCCCAGGTACCTCTACTCCGGAAAGCGGCTCTGCATCTCCAGGTA
CTTCTACCCCTGAAAGCGGTTCTGCATCTCCA |
| AE624 | 118 | ATGGCTGAACCTGCTGGCTCTCCAACCTCCACTGAGGAAGGTACCCCGGGTAGC
GGTACTGCTTCTTCCTCTCCAGGTAGCTCTACCCCTTCTGGTGCAACCGGCTCTC
CAGGTGCTTCTCCGGGCACCAGCTCTACCGGTTCTCCAGGTAGCCCGGCTGGCT
CTCCTACCTCTACTGAGGAAGGTACTTCTGAAAGCGCTACTCCTGAGTCTGGTCC
AGGTACCTCTACTGAACCGTCCGAAGGTAGCGCTCCAGGTAGCCCAGCAGGCTC
TCCGACTTCCACTGAGGAAGGTACTTCTACTGAACCTTCCGAAGGCAGCGCACC
AGGTACCTCTACTGAACCTTCTGAGGGCAGCGCTCCAGGTACTTCTGAAAGCGC
TACCCCGGAATCTGGCCCAGGTAGCGAACCGGCTACTTCTGGTTCTGAAACCCC
AGGTAGCGAACCGGCTACCTCCGGTTCTGAAACTCCAGGTAGCCCGGCAGGCTC
TCCGACCTCTACTGAGGAAGGTACTTCTGAAAGCGCAACCCCGGAGTCCGGCCC
AGGTACCTCTACCGAACCGTCTGAGGGCAGCGCACCAGGTACTTCTACCGAACC
GTCCGAGGGTAGCGCACCAGGTAGCCCAGCAGGTTCTCCTACCTCCACCGAGGA
AGGTACTTCTACCGAACCGTCCGAGGGTAGCGCACCAGGTACCTCTACTGAACC
TTCTGAGGGCAGCGCTCCAGGTACTTCTGAAAGCGCTACCCCGGAGTCCGGTCC
AGGTACTTCTACTGAACCGTCCGAAGGTAGCGCACCAGGTACTTCTGAAAGCGC
AACCCCTGAATCCGGTCCAGGTAGCGAACCGGCTACTTCTGGCTCTGAGACTCC
AGGTACTTCTACCGAACCGTCCGAAGGTAGCGCACCAGGTACTTCTACTGAACC
GTCTGAAGGTAGCGCACCAGGTACTTCTGAAAGCGCAACCCCGGAATCCGGCCC
AGGTACCTCTGAAAGCGCAACCCCGGAGTCCGGCCCAGGTAGCCCTGCTGGCTC
TCCAACCTCCACCGAAGAAGGTACCTCTGAAAGCGCAACCCCTGAATCCGGCCC
AGGTAGCGAACCGGCAACCTCCGGTTCTGAAACCCCAGGTACCTCTGAAAGCGC
TACTCCGGAGTCTGGCCCAGGTACCTCTACTGAACCGTCTGAGGGTAGCGCTCC
AGGTACTTCTACTGAACCGTCCGAAGGTAGCGCACCAGGTACTTCTACCGAACC
GTCCGAAGGCAGCGCTCCAGGTACCTCTACTGAACCTTCCGAGGGCAGCGCTCC
AGGTACCTCTACCGAACCTTCTGAAAGTAGCGCACCAGGTACTTCTACCGAACC
GTCGAGGGTAGCGCACCAGGTAGCCCAGCAGGTTCTCCTACCTCCACCGAGGA
AGGTACTTCTACCGAACCGTCCGAGGGTAGCGCACCAGGTACCTCTGAAAGCGC
AACTCCTGAGTCTGGCCCAGGTAGCGAACCTGCTACCTCCGGCTCTGAGACTCC
AGGTACCTCTGAAAGCGCAACCCCGGAATCTGGTCCAGGTAGCGAACCTGCAAC
CTCTGGCTCTGAAACCCCAGGTACCTCTGAAAGCGCTACTCCTGAATCTGGCCC
AGGTACTTCTACTGAACCGTCCGAGGGCAGCGCACCAGGTACTTCTGAAAGCGC
TACTCCTGAGTCCGGCCCAGGTAGCCCGGCTGGCTCTCCGACTTCCACCGAGGA
AGGTAGCCCGGCTGGCTCTCCAACTTCTACTGAAGAAGGTAGCCCGGCAGGCTC
TCCGACCTCTACTGAGGAAGGTACTTCTGAAAGCGCAACCCCGGAGTCCGGCCC
AGGTACCTCTACCGAACCGTCTGAGGGCAGCGCACCA |
| AM875 | 119 | GGTACTTCTACTGAACCGTCTGAAGGCAGCGCACCAGGTAGCGAACCGGCTACT
TCCGGTTCTGAAACCCCAGGTAGCCCAGCAGGTTCTCCAACTTCTACTGAAGAA
GGTTCTACCAGCTCTACCGCAGAATCTCCTGGTCCAGGTACCTCTACTCCGGAA
AGCGGCTCTGCATCTCCAGGTTCTACTAGCGAATCTCCTTCTGGCACTGCACCAG
GTTCTACTAGCGAATCCCCGTCTGGTACTGCTCCAGGTACTTCTACTCCTGAAAG
CGGTTCCGCTTCTCCAGGTACCTCTACTCCGGAAAGCGGTTCTGCATCTCCAGGT
AGCGAACCGGCAACCTCCGGCTCTGAAACCCCAGGTACCTCTGAAAGCGCTACT
CCTGAATCCGGCCCAGGTAGCCCCGGCAGGTTCTCCGACTTCCACTGAGGAAGGT
ACCTCTACTGAACCTTCTGAGGGCAGCGCTCCAGGTACTTCTGAAAGCGCTACC
CCGGAGTCCGGTCAGGTACTTCTACTGAACCGTCCGAAGGTAGCGCACCAGGT
ACTTCTACCGAACCGTCCGAGGGTAGCGCACCAGGTAGCCCAGCAGGTTCTCCT
ACCTCCACCGAGGAAGGTACTTCTACCGAACCGTCCGAGGGTAGCGCACCAGGT
ACTTCTACCGAACCTTCCGAGGGCAGCGCACCAGGTACTTCTGAAAGCGCTACC
CCTGAGTCCGGCCCAGGTACTTCTGAAAGCGCTACTCCTGAATCCGGTCCAGGT
ACCTCTACTGAACCTTCCGAAGGCAGCGCTCCAGGTACCTCTACCGAACCGTCC
GAGGGCAGCGCACCAGGTACTTCTGAAAGCGCAACCCCTGAATCCGGTCCAGGT
ACTTCTACTGAACCTTCCGAAGGTAGCGCTCCAGGTAGCGAACCTGCTACTTCT
GGTTCTGAAACCCCAGGTAGCCCGGCTGGCTCTCCGACCTCCACCGAGGAAGGT
AGCTCTACCCCGTCTGGTGCTACTGGTTCTCCAGGTACTCCGGGCAGCGGTACTG
CTTCTTCCTCTCCAGGTAGCTCTACCCCTTCTGGTGCTACTGGCTCTCCAGGTAC
CTCTACCGAACCGTCCGAGGGTAGCGCACCAGGTACCTCTACTGAACCGTCTGA
GGGTAGCGCTCCAGGTAGCGAACCGGCAACCTCCGGTTCTGAAACTCCAGGTAG
CCCTGCTGGCTCTCCGACTTCTACTGAGGAAGGTAGCCCGGCTGGTTCTCCGACT
TCTACTGAGGAAGGTACTTCTACCGAACCTTCCGAAGGTAGCGCTCCAGGTGCA
AGCGCAAGCGGCGCCAAGCACGGGAGGTACTTCTGAAAGCGCTACTCCTGA
GTCCGGCCCAGGTAGCCCGGCTGGCTCTCCGACTTCCACCGAGGAAGGTAGCCC
GGCTGGCTCTCCAACTTCTACTGAAGAAGGTTCTACCAGCTCTACCGCTGAATCT
CCTGGCCCAGGTTCTACTAGCGAATCTCCGTCTGGCACCGCACCAGGTACTTCCC
CTAGCGGTGAATCTTCTACTGCACCAGGTACCCCTGGCAGCGGTACCGCTTCTTC
CTCTCCAGGTAGCTCTACCCCGTCTGGTGCTACTGGCTCTCCAGGTTCTAGCCCG |

TABLE 8-continued

DNA sequences of XTEN and precursor sequences

| XTEN Name | SEQ ID NO: | DNA Nucleotide Sequence |
|---|---|---|
| | | TCTGCATCTACCGGTACCGGCCCAGGTAGCGAACCGGCAACCTCCGGCTCTGAA<br>ACTCCAGGTACTTCTGAAAGCGCTACTCCGGAATCCGGCCCAGGTAGCGAACCG<br>GCTACTTCCGGCTCTGAAACCCCAGGTTCCACCAGCTCTACTGCAGAATCTCCG<br>GGCCCAGGTTCTACTAGCTCTACTGCAGAATCTCCGGGTCCAGGTACTTCTCCTA<br>GCGGCGAATCTTCTACCGCTCCAGGTAGCGAACCGGCAACCTCTGGCTCTGAAA<br>CTCCAGGTAGCGAACCTGCAACCTCCGGCTCTGAAACCCCAGGTACTTCTACTG<br>AACCTTCTGAGGGCAGCGCACCAGGTTCTACCAGCTCTACCGCAGAATCTCCTG<br>GTCCAGGTACCTCTACTCCGGAAAGCGGCTCTGCATCTCCAGGTTCTACTAGCG<br>AATCTCCTTCTGGCACTGCACCAGGTACTTCTACCGAACCGTCCGAAGGCAGCG<br>CTCCAGGTACCTCTACTGAACCTTCCGAGGGCAGCGCTCCAGGTACCTCTACCG<br>AACCTTCTGAAGGTAGCGCACCAGGTAGCTCTACTCCGTCTGGTGCAACCGGCT<br>CCCCAGGTTCTAGCCCGTCTGCTTCCACTGGTACTGGCCCAGGTGCTTCCCGGG<br>CACCAGCTCTACTGGTTCTCCAGGTAGCGAACCTGCTACCTCCGGTTCTGAAACC<br>CCAGGTACCTCTGAAAGCGCAACTCCGGAGTCTGGTCCAGGTAGCCCTGCAGGT<br>TCTCCTACCTCCACTGAGGAAGGTAGCTCTACTCCGTCTGGTGCAACCGGCTCCC<br>CAGGTTCTAGCCCGTCTGCTTCCACTGGTACTGGCCAGGTGCTTCCCGGGCAC<br>CAGCTCTACTGGTTCTCCAGGTACCTCTGAAAGCGCTACTCCGGAGTCTGGCCC<br>AGGTACCTCTACTGAACCGTCTGAGGGTAGCGCTCCAGGTACTTCTACTGAACC<br>GTCCGAAGGTAGCGCACCA |
| AE864 | 120 | GGTAGCCCGGCTGGCTCTCCTACCTCTACTGAGGAAGGTACTTCTGAAAGCGCT<br>ACTCCTGAGTCTGGTCCAGGTACCTCTACTGAACCGTCCGAAGGTAGCGCTCCA<br>GGTAGCCCAGCAGGCTCTCCGACTTCCACTGAGGAAGGTACTTCTACTGAACCT<br>TCCGAAGGCAGCGCACCAGGTACCTCTACTGAACCTTCTGAGGGCAGCGCTCCA<br>GGTACTTCTGAAAGCGCTACCCCGGAATCTGGCCCAGGTAGCGAACCGGCTACT<br>TCTGGTTCTGAAACCCCAGGTAGCGAACCGGCTACCTCCGGTTCTGAAACTCCA<br>GGTAGCCCGGCAGGCTCTCCGACCTCTACTGAGGAAGGTACTTCTGAAAGCGCA<br>ACCCCGGAGTCCGGCCCAGGTACCTCTACCGAACCGTCGAGGGCAGCGCACCA<br>GGTACTTCTACCGAACCGTCCGAGGGTAGCGCACCAGGTAGCCCAGCAGGTTCT<br>CCTACCTCCACCGAGGAAGGTACTTCTACCGAACCGTCCGAGGGTAGCGCACCA<br>GGTACCTCTACTGAACCTTCTGAGGGCAGCGCTCCAGGTACTTCTGAAAGCGCT<br>ACCCCGGAGTCCGGTCCAGGTACTTCTACTGAACCGTCCGAAGGTAGCGCACCA<br>GGTACTTCTGAAAGCGCAACCCCTGAATCCGGTCCAGGTAGCGAACCGGCTACT<br>TCTGGCTCTGAGACTCCAGGTACTTCTACCGAACCGTCCGAAGGTAGCGCACCA<br>GGTACTTCTACTGAACCGTCTGAAGGTAGCGCACCAGGTACTTCTGAAAGCGCA<br>ACCCCGGAATCCGGCCCAGGTACCTCTGAAAGCGCAACCCCGGAGTCCGGCCC<br>AGGTAGCCCTGCTGGCTCTCCAACCTCCACCGAAGAAGGTACCTCTGAAAGCGC<br>AACCCCTGAATCCGGCCCAGGTAGCGAACCGGCAACCTCCGGTTCTGAAACCCC<br>AGGTACCTCTGAAAGCGCTACTCCGGAGTCTGGCCCAGGTACCTCTACTGAACC<br>GTCTGAGGGTAGCGCTCCAGGTACTTCTACTGAACCGTCCGAAGGTAGCGCACC<br>AGGTACTTCTACCGAACCGTCCGAAGGCAGCGCTCCAGGTACCTCTACTGAACC<br>TTCCGAGGGCAGCGCTCCAGGTACCTCTACCGAACCTTCTGAAGGTAGCGCACC<br>AGGTACTTCTACCGAACCGTCCGAGGGTAGCGCACCAGGTAGCCCAGCAGGTTC<br>TCCTACCTCCACCGAGGAAGGTACTTCTACCGAACCGTCCGAGGGTAGCGCACC<br>AGGTACCTCTGAAAGCGCAACTCCTGAGTCTGGCCCAGGTAGCGAACCTGCTAC<br>CTCCGGCTCTGAGACTCCAGGTACCTCTGAAAGCGCAACCCCGGAATCTGGTCC<br>AGGTAGCGAACCTGCAACCTCTGGCTCTGAAACCCCAGGTACCTCTGAAAGCGC<br>TACTCCTGAATCTGGCCCAGGTACTTCTACTGAACCGTCCGAGGGCAGCGCACC<br>AGGTACTTCTGAAAGCGCTACTCCTGAGTCCGGCCCAGGTAGCCCGGCTGGCTC<br>TCCGACTTCCACCGAGGAAGGTAGCCCGGCTGGCTCTCCAACTTCTACTGAAGA<br>AGGTAGCCCGGCAGGCTCTCCGACCTCTACTGAGGAAGGTACTTCTGAAAGCGC<br>AACCCCGGAGTCCGGCCCAGGTACCTCTACCGAACCGTCTGAGGGCAGCGCACC<br>AGGTACCTCTGAAAGCGCAACTCCTGAGTCGGTGGCCCAGGTAGCGAACCTGCTAC<br>CTCCGGCTCTGAGACTCCAGGTACCTCTGAAAGCGCAACCCCGGAATCTGGTCC<br>AGGTAGCGAACCTGCAACCTCTGGCTCTGAAACCCCAGGTACCTCTGAAAGCGC<br>TACTCCTGAATCTGGCCCAGGTACTTCTACTGAACCGTCCGAGGGCAGCGCACC<br>AGGTAGCCCTGCTGGCTCTCCAACCTCCACCGAAGAAGGTACCTCTGAAAGCGC<br>AACCCCTGAATCCGGCCCAGGTAGCGAACCGGCAACCTCCGGTTCTGAAACCCC<br>AGGTACTTCTGAAAGCGCTACTCCTGAGTCCGGCCCAGGTAGCCCGGCTGGCTC<br>TCCGACTTCCACCGAGGAAGGTAGCCCGGCTGGCTCTCCAACTTCTACTGAAGA<br>AGGTACTTCTACCGAACCTTCCGAGGGCAGCGCACCAGGTACTTCTGAAAGCGC<br>TACCCCGAGTCCGGCCCAGGTACTTCTGAAAGCGCTACTCCTGAATCCGGTCC<br>AGGTACTTCTGAAAGCGCTACCCCGGAATCTGGCCCAGGTAGCGAACCGGCTAC<br>TTCTGGTTCTGAAACCCCAGGTAGCGAACCGGCTACCTCCGGTTCTGAAACTCC<br>AGGTAGCCCAGCAGGCTCTCCGACTTCCACTGAGGAAGGTACTTCTACTGAACC<br>TTCCGAAGGCAGCGCACCAGGTACCTCTACTGAACCTTCTGAGGGCAGCGCTCC<br>AGGTAGCGAACCTGCAACCTCTGGCTCTGAAACCCCAGGTACCTCTGAAAGCGC<br>TACTCCTGAATCTGGCCCAGGTACTTCTACTGAACCGTCCGAGGGCAGCGCACCA |
| AF864 | 121 | GGTTCTACCAGCGAATCTCCTTCTGGCACCGCTCCAGGTACCTCTCCTAGCGGCG<br>AATCTTCTACCGCTCCAGGTTCTACTAGCGAATCTCCTTCTGGCACTGCACCAGG<br>TTCTACTAGCGAATCCCCGTCTGGTACTGCTCCAGGTACTTCTACTCCTGAAAGC<br>GGTTCCGCTTCTCCAGGTACCTCTACTCCGGAAAGCGGTTCTGCATCTCCAGGTT<br>CTACCAGCGAATCTCCTTCTGGCACCGCTCCAGGTTCTACTAGCGAATCCCGTC<br>TGGTACCGCACCAGGTACTTCTCCTAGCGGCGAATCTTCTACCGCACCAGGTTCT |

TABLE 8-continued

DNA sequences of XTEN and precursor sequences

| XTEN Name | SEQ ID NO: | DNA Nucleotide Sequence |
|---|---|---|
| | | ACTAGCGAATCTCCGTCTGGCACTGCTCCAGGTACTTCTCCTAGCGGTGAATCTT<br>CTACCGCTCCAGGTACTTCCCTAGCGGCGAATCTTCTACCGCTCCAGGTTCTAC<br>TAGCTCTACTGCAGAATCTCCGGGCCCAGGTACCTCTCCTAGCGGTGAATCTTCT<br>ACCGCTCCAGGTACTTCTCCGAGCGGTGAATCTTCTACCGCTCCAGGTTCTACTA<br>GCTCTACTGCAGAATCTCCTGGCCCAGGTACCTCTACTCCGGAAAGCGGCTCTG<br>CATCTCCAGGTACTTCTACCCCTGAAAGCGGTTCTGCATCTCCAGGTTCTACTAG<br>CGAATCTCCTTCTGGCACTGCACCAGGTTCTACCAGCGAATCTCCGTCTGGCACT<br>GCACCAGGTACCTCTACCCCTGAAAGCGGTTCCGCTTCTCCAGGTTCTACCAGCT<br>CTACCGCAGAATCTCCTGGTCCAGGTACCTCTACTCCGGAAAGCGGCTCTGCAT<br>CTCCAGGTTCTACTAGCGAATCTCCTTCTGGCACTGCACCAGGTACTTCTCCGAG<br>CGGTGAATCTTCTACCGCACCAGGTTCTACTAGCTCTACCGCTGAATCTCCGGGC<br>CCAGGTACTTCTCGAGCGGTGAATCTTCTACTGCTCCAGGTACCTCTACTCCTG<br>AAAGCGGTTCTGCATCTCCAGGTTCCACTAGCTCTACCGCAGAATCTCCGGGCC<br>CAGGTTCTACTAGCTCTACTGCTGAATCTCCTGGCCCAGGTTCTACTAGCTCTAC<br>TGCTGAATCTCCGGGTCCAGGTTCTACCAGCTCTACTGCTGAATCTCCTGGTCCA<br>GGTACCTCCCCGAGCGGTGAATCTTCTACTGCACCAGGTTCTACTAGCGAATCTC<br>CTTCTGGCACTGCACCAGGTTCTACCAGCGAATCTCCGTCTGGCACTGCACCAG<br>GTACCTCTACCCCTGAAAGCGGTCCXXXXXXXXXXXXXTGCAAGCGCAAGCGGC<br>GCGCCAAGCACGGGAXXXXXXXXXTAGCGAATCTCCTTCTGGTACCGCTCCAGGT<br>TCTACCAGCGAATCCCCGTCTGGTACTGCTCCAGGTTCTACCAGCGAATCTCCTT<br>CTGGTACTGCACCAGGTTCTACTAGCGAATCTCCTTCTGGTACCGCTCCAGGTTC<br>TACCAGCGAATCCCCGTCTGGTACTGCTCCAGGTTCTACCAGCGAATCTCCTTCT<br>GGTACTGCACCAGGTACTTCTACTCCGGAAAGCGGTTCCGCATCTCCAGGTACT<br>TCTCCTAGCGGTGAATCTTCTACTGCTCCAGGTACCTCTCCTAGCGGCGAATCTT<br>CTACTGCTCCAGGTTCTACCAGCTCTACTGCTGAATCTCCGGGTCCAGGTACTTC<br>CCCGAGCGGTGAATCTTCTACTGCACCAGGTACTTCTACTCCGGAAAGCGGTTC<br>CGCTTCTCCAGGTTCTACCAGCGAATCTCCTTCTGGCACCGCTCCAGGTTCTACT<br>AGCGAATCCCCGTCTGGTACCGCACCAGGTACTTCTCCTAGCGGCGAATCTTCT<br>ACCGCACCAGGTTCTACTAGCGAATCCCCGTCTGGTACCGCACCAGGTACTTCT<br>ACCCCGGAAAGCGGCTCTGCTTCTCCAGGTACTTCTACCCCGGAAAGCGGCTCC<br>GCATCTCCAGGTTCTACTAGCGAATCTCCTTCTGGTACCGCTCCAGGTACTTCTA<br>CCCCTGAAAGCGGCTCCGCTTCTCCAGGTTCCACTAGCTCTACCGCTGAATCTCC<br>GGGTCCAGGTTCTACCAGCGAATCTCCTTCTGGCACCGCTCCAGGTTCTACTAGC<br>GAATCCCCGTCTGGTACCGCACCAGGTACTTCTCCTAGCGGCGAATCTTCTACCG<br>CACCAGGTTCTACCAGCTCTACTGCTGAATCTCCGGGTCCAGGTACTTCCCCGAG<br>CGGTGAATCTTCTACTGCACCAGGTACTTCTACTCCGGAAAGCGGTTCCGCTTCT<br>CCAGGTACCTCCCCTAGCGGCGAATCTTCTACTGCTCCAGGTACCTCTCCTAGCG<br>GCGAATCTTCTACCGCTCCAGGTACCTCCCCTAGCGGTGAATCTTCTACCGCACC<br>AGGTTCTACTAGCTCTACTGCTGAATCTCCGGGTCCAGGTTCTACCAGCTCTACT<br>GCTGAATCTCCTGGTCCAGGTACCTCCCGAGCGGTGAATCTTCTACTGCACCA<br>GGTTCTAGCCCTTCTGCTTCCACCGGTACCGGCCCAGGTAGCTCTACTCCGTCTG<br>GTGCAACTGGCTCTCCAGGTAGCTCTACTCCGTCTGGTGCAACCGGCTCCCCA<br>XXXX was inserted in two areas where no sequence information is available. |
| AG864 | 122 | GGTGCTTCCCCGGGCACCAGCTCTACTGGTTCTCCAGGTTCTAGCCCGTCTGCTT<br>CTACTGGTACTGGTCCAGGTTCTAGCCCTTCTGCTTCCACTGGTACTGGTCCAGG<br>TACCCCGGGTAGCGGTACCGCTTCTTCTTCTCCAGGTAGCTCTACTCCGTCTGGT<br>GCTACCGGCTCTCCAGGTTCTAACCCTTCTGCATCCACCGGTACCGGCCCAGGTG<br>CTTCTCCGGGCACCAGCTCTACTGGTTCTCCAGGTACCCCGGGCAGCGGTACCG<br>CATCTTCTTCTCCAGGTAGCTCTACTCCTTCTGGTGCAACTGGTTCTCCAGGTAC<br>TCCTGGCAGCGGTACCGCTTCTTCTTCTCCAGGTGCTTCTCCTGGTACTAGCTCT<br>ACTGGTTCTCCAGGTGCTTCTCCGGGCACTAGCTCTACTGGTTCTCCAGGTACCC<br>CGGGTAGCGGTACTGCTTCTTCCTCTCCAGGTAGCTCTACCCCTTCTGGTGCAAC<br>CGGCTCTCCAGGTGCTTCTCCGGGCACCAGCTCTACCGGTTCTCCAGGTACCCCG<br>GGTAGCGGTACCGCTTCTTCTTCTCCAGGTAGCTCTACTCCGTCTGGTGCTACCG<br>GCTCTCCAGGTTCTAACCCTTCTGCATCCACCGGTACCGGCCCAGGTTCTAGCCC<br>TTCTGCTTCCACCGGTACTGGCCCAGGTAGCTCTACCCCTTCTGGTGCTACCGGC<br>TCCCCAGGTAGCTCTACTCCTTCTGGTGCAACTGGCTCTCCAGGTGCATCTCCGG<br>GCACTAGCTCTACTGGTTCTCCAGGTGCATCCCCTGGCACTAGCTCTACTGGTTC<br>TCCAGGTGCTTCTCCTGGTACCAGCTCTACTGGTTCTCCAGGTACTCCTGGCAGC<br>GGTACCGCTTCTTCTTCTCCAGGTGCTTCTCCTGGTACTAGCTCTACTGGTTCTCC<br>AGGTGCTTCTCCGGGCACTAGCTCTACTGGTTCTCCAGGTGCTTCCCCGGGCACT<br>AGCTCTACCGGTTCTCCAGGTTCTAGCCCTTCTGCATCTACTGGTACTGGCCCAG<br>GTACTCCGGGCAGCGGTACTGCTTCTTCCTCTCCAGGTGCATCTCCGGGCACTAG<br>CTCTACTGGTTCTCCAGGTGCATCCCCTGGCACTAGCTCTACTGGTTCTCCAGGT<br>GCTTCTCCTGGTACCAGCTCTACTGGTTCTCCAGGTAGCTCTACTCCGTCTGGTG<br>CAACCGGTTCCCCAGGTAGCTCTACTCCTTCTGGTGCTACTGGCTCCCAGGTGC<br>ATCCCCTGGCACCAGCTCTACCGGTTCTCCAGGTACCCCGGGCAGCGGTACCGC<br>ATCTTCCTCTCCAGGTAGCTCTACCCCGTCTGGTGCTACCGGTTCCCCAGGTAGC<br>TCTACCCCGTCTGGTGCAACCGGCTCCCCAGGTAGCTCTACTCCGTCTGGTGCAA<br>CCGGCTCCCCAGGTTCTAGCCCGTCTGCTTCCACTGGTACTGGCCCAGGTGCTTC<br>CCGGGCACCAGCTCTACTGGTTCTCCAGGTGCATCCCGGGTACCAGCTCTAC<br>CGGTTCTCCAGGTACTCCTGGCAGCGGTACTGCATCTTCCTCTCCAGGTGCTTCT<br>CCGGGCACCAGCTCTACTGGTTCTCCAGGTGCATCTCCGGGCACTAGCTCTACTG |

TABLE 8-continued

DNA sequences of XTEN and precursor sequences

| XTEN Name | SEQ ID NO: | DNA Nucleotide Sequence |
|---|---|---|
| | | GTTCTCCAGGTGCATCCCCTGGCACTAGCTCTACTGGTTCTCCAGGTGCTTCTCC<br>TGGTACCAGCTCTACTGGTTCTCCAGGTACCCCTGGTAGCGGTACTGCTTCTTCC<br>TCTCCAGGTAGCTCTACTCCGTCTGGTGCTACCGGTTCTCCAGGTACCCCGGGTA<br>GCGGTACCGCATCTTCTTCTCCAGGTAGCTCTACCCCGTCTGGTGCTACTGGTTC<br>TCCAGGTACTCCGGGCAGCGGTACTGCTTCTTCCTCTCCAGGTAGCTCTACCCCT<br>TCTGGTGCTACTGGCTCTCCAGGTAGCTCTACCCCGTCTGGTGCTACTGGCTCCC<br>AGGTTCTAGCCCCTTCTGCATCCACCGGTACCGGTCCAGGTTCTAGCCCGTCTGC<br>ATCTACTGGTACTGGTCCAGGTGCATCCCCGGGCACTAGCTCTACCGGTTCTCCA<br>GGTACTCCTGGTAGCGGTACTGCTTCTTCTTCTCCAGGTAGCTCTACTCCTTCTG<br>GTGCTACTGGTTCTCCAGGTTCTAGCCCTTCTGCATCCACCGGTACCGGCCCAGG<br>TTCTAGCCCGTCTGCTTCTACCGGTACTGGTCCAGGTGCTTCTCCGGGTACTAGC<br>TCTACTGGTTCTCCAGGTGCATCTCCTGGTACTAGCTCTACTGGTTCTCCAGGTA<br>GCTCTACTCCGTCTGGTGCAACCGGCTCTCCAGGTTCTAGCCCTTCTGCATCTAC<br>CGGTACTGGTCCAGGTGCATCCCTGGTACCAGCTCTACCGGTTCTCCAGGTTCT<br>AGCCCTTCTGCTTCTACCGGTACCGGTCCAGGTACCCCTGGCAGCGGTACCGCA<br>TCTTCCTCTCAGGTAGCTCTACTCCGTCTGGTGCAACCGGTTCCCCAGGTAGCT<br>CTACTCCTTCTGGTGCTACTGGCTCCCCAGGTGCATCCCCTGGCACCAGCTCTAC<br>CGGTTCTCCA |
| AM923 | 123 | ATGGCTGAACCTGCTGGCTCTCCAACCTCCACTGAGGAAGGTGCATCCCCGGGC<br>ACCAGCTCTACCGGTTCTCCAGGTAGCTCTACCCCGTCTGGTGCTACCGGCTCTC<br>AGGTAGCTCTACCCCGTCTGGTGCTACTGGCTCTCCAGGTACTTCTACTGAACC<br>GTCTGAAGGCAGCGCACCAGGTAGCGAACCGGCTACTTCCGGTTCTGAAACCCC<br>AGGTAGCCCAGCAGGTTCTCCAACTTCTACTGAAGAAGGTTCTACCAGCTCTAC<br>CGCAGAATCTCCTGGTCCAGGTACCTCTACTCCGGAAAGCGGCTCTGCATCTCC<br>AGGTTCTACTAGCGAATCTCCTTCTGGCACTGCACCAGGTTCTACTAGCGAATCC<br>CCGTCTGGTACTGCTCCAGGTACTTCTACTCCTGAAAGCGGTTCCGCTTCTCCAG<br>GTACCTCTACTCCGGAAAGCGGTTCTGCATCTCCAGGTAGCGAACCGGCAACCT<br>CCGGCTCTGAAACCCCAGGTACCTCTGAAAGCGCTACTCCTGAATCCGGCCCAG<br>GTAGCCCGGCAGGTTCTCCGACTTCCACTGAGGAAGGTACCTCTACTGAACCTT<br>CTGAGGGCAGCGCTCCAGGTACTTCTGAAAGCGCTACCCCGGAGTCCGGTCCAG<br>GTACTTCTACTGAACCGTCCGAAGGTAGCGCACCAGGTACTTCTACCGAACCGT<br>CCGAGGGTAGCGCACCAGGTAGCCCAGCAGGTTCTCCTACCTCCACCGAGGAAG<br>GTACTTCTACCGAACCGTCCGAGGGTAGCGCACCAGGTACTTCTACCGAACCTT<br>CCGAGGGCAGCGCACCAGGTACTTCTGAAAGCGCTACCCCTGAGTCCGGCCCAG<br>GTACTTCTGAAAGCGCTACTCCTGAATCCGGTCCAGGTACCTCTACTGAACCTTC<br>CGAAGGCAGCGCTCCAGGTACCTCTACCGAACCGTCCGAGGGCAGCGCACCAG<br>GTACTTCTGAAAGCGCAACCCCTGAATCCGGTCCAGGTACTTCTACTGAACCTTC<br>CGAAGGTAGCGCTCCAGGTAGCGAACCTGCTACTTCTGGTTCTGAAACCCCAGG<br>TAGCCCGGCTGGCTCTCCGACCTCCACCGAGGAAGGTAGCTCTACCCCGTCTGG<br>TGCTACTGGTTCTCCAGGTACTCGGGCAGCGGTACTGCTTCTTCCTCTCCAGGT<br>AGCTCTACCCCTTCTGGTGCTACTGGCTCTCCAGGTACCTCTACCGAACCGTCCG<br>AGGGTAGCGCACCAGGTACCTCTACTGAACCGTCTGAGGGTAGCGCTCCAGGTA<br>GCGAACCGGCAACCTCCGGTTCTGAAACTCCAGGTAGCCCTGCTGGCTCTCCGA<br>CTTCTACTGAGGAAGGTAGCCCGGCTGGTTCTCCGACTTCTACTGAGGAAGGTA<br>CTTCTACCGAACCTTCCGAAGGTAGCGCTCCAGGTGCAAGCGCAAGCGGCGCGC<br>CAAGCACGGGAGGTACTTCTGAAAGCGCTACTCCTGAGTCCGGCCCAGGTAGCC<br>CGGCTGGCTCTCCGACTTCCACCGAGGAAGGTAGCCCGGCTGGCTCTCCAACTT<br>CTACTGAAGAAGGTTCTACCAGCTCTACCGCTGAATCTCCTGGCCCAGGTTCTAC<br>TAGCGAATCTCCGTCTGGCACCGCACCAGGTACTTCCCCTAGCGGTGAATCTTCT<br>ACTGCACCAGGTACCCCTGGCAGCGGTACCGCTTCTTCCTCTCCAGGTAGCTCTA<br>CCCCGTCTGGTGCTACTGGCTCTCCAGGTTCTAGCCCGTCTGCATCTACCGGTAC<br>CGGCCCAGGTAGCGAACCGGCAACCTCCGGCTCTGAAACTCCAGGTACTTCTGA<br>AAGCGCTACTCCGGAATCCGGCCCAGGTAGCGAACCGGCTACTTCCGGCTCTGA<br>AACCCCAGGTTCCACCAGCTCTACTGCAGAATCTCCGGGCCCAGGTTCTACTAG<br>CTCTACTGCAGAATCTCCGGGTCCAGGTACTTCTCCTAGCGGCGAATCTTCTACC<br>GCTCCAGGTAGCGAACCGGCAACCTCTGGCTCTGAAACTCCAGGTAGCGAACCT<br>GCAACCTCCGGCTCTGAAACCCCAGGTACTTCTACTGAACCTTCTGAGGGCAGC<br>GCACCAGGTTCTACCAGCTCTACCGCAGAATCTCCTGGTCCAGGTACCTCTACTC<br>CGGAAAGCGGCTCTGCATCTCCAGGTTCTACTAGCGAATCTCCTTCTGGCACTGC<br>ACCAGGTACTTCTACCGAACCGTCCGAAGGCAGCGCTCCAGGTACCTCTACTGA<br>ACCTTCCGAGGGCAGCGCTCCAGGTACCTCTACCGAACCTTCTGAAGGTAGCGC<br>ACCAGGTAGCTCTACTCCGTCTGGTGCAACCGGCTCCCAGGTTCTAGCCCGTCT<br>GCTTCCACTGGTACTGGCCCAGGTGCTTCCCCGGGCACCAGCTCTACTGGTTCTC<br>AGGTAGCGAACCTGCTACCTCCGGTTCTGAAACCCAGGTACCTCTGAAAGCG<br>CAACTCCGGAGTCTGGTCAGGTAGCCCTGCAGGTTCTCCTACCTCCACTGAGG<br>AAGGTAGCTCTACTCCGTCTGGTGCAACCGGCTCCCAGGTTCTAGCCCGTCTGC<br>TTCCACTGGTACTGGCCCAGGTGCTTCCCCGGGCACCAGCTCTACTGGTTCTCCA<br>GGTACCTCTGAAAGCGCTACTCCGGAGTCTGGCCCAGGTACCTCTACTGAACCG<br>TCTGAGGGTAGCGCTCCAGGTACTTCTACTGAACCGTCCGAAGGTAGCGCACCA |
| AE912 | 124 | ATGGCTGAACCTGCTGGCTCTCCAACCTCCACTGAGGAAGGTACCCCGGGTAGC<br>GGTACTGCTTCTTCCTCTCCAGGTAGCTCTACCCCTTCTGGTGCAACCGGCTCTC<br>AGGTGCTTCTCCGGGCACCAGCTCTACCGGTTCTCCAGGTAGCCCGGCTGGCT<br>CTCCTACCTCTACTGAGGAAGGTACTTCTGAAAGCGCTACTCCTGAGTCTGGTCC |

TABLE 8-continued

DNA sequences of XTEN and precursor sequences

| XTEN Name | SEQ ID NO: | DNA Nucleotide Sequence |
|---|---|---|
| | | AGGTACCTCTACTGAACCGTCCGAAGGTAGCGCTCCAGGTAGCCCAGCAGGCTC<br>TCCGACTTCCACTGAGGAAGGTACTTCTACTGAACCTTCCGAAGGCAGCGCACC<br>AGGTACCTCTACTGAACCTTCTGAGGGCAGCGCTCCAGGTACTTCTGAAAGCGC<br>TACCCCGGAATCTGGCCCAGGTAGCGAACCGGCTACTTCTGGTTCTGAAACCCC<br>AGGTAGCGAACCGGCTACCTCCGGTTCTGAAACTCCAGGTAGCCCGGCAGGCTC<br>TCCGACCTCTACTGAGGAAGGTACTTCTGAAAGCGCAACCCCGGAGTCCGGCCC<br>AGGTACCTCTACCGAACCGTCTGAGGGCAGCGCACCAGGTACTTCTACCGAACC<br>GTCCGAGGGTAGCGCACCAGGTAGCCCAGCAGGTTCTCCTACCTCCACCGAGGA<br>AGGTACTTCTACCGAACCGTCCGAGGGTAGCGCACCAGGTACCTCTACTGAACC<br>TTCTGAGGGCAGCGCTCCAGGTACTTCTGAAAGCGCTACCCCGGAGTCCGGTCC<br>AGGTACTTCTACTGAACCGTCCGAAGGTAGCGCACCAGGTACTTCTGAAAGCGC<br>AACCCCTGAATCCGGTCCAGGTAGCGAACCGGCTACTTCTGGCTCTGAGACTCC<br>AGGTACTTCTACCGAACCGTCCGAAGGTAGCGCACCAGGTACTTCTACTGAACC<br>GTCTGAAGGTAGCGCACCAGGTACTTCTGAAAGCGCAACCCCGGAATCCGGCCC<br>AGGTACCTCTGAAAGCGCAACCCCGGAGTCCGGCCCAGGTAGCCCTGCTGGCTC<br>TCCAACCTCCACCGAAGAAGGTACCTCTGAAAGCGCAACCCCTGAATCCGGCCC<br>AGGTAGCGAACCGGCAACCTCCGGTTCTGAAACCCCAGGTACCTCTGAAAGCGC<br>TACTCCGGAGTCTGGCCCAGGTACCTCTACTGAACCGTCTGAGGGTAGCGCTCC<br>AGGTACTTCTACTGAACCGTCCGAAGGTAGCGCACCAGGTACTTCTACCGAACC<br>GTCCGAAGGCAGCGCTCCAGGTACCTCTACTGAACCTTCCGAGGGCAGCGCTCC<br>AGGTACCTCTACCGAACCTTCTGAAGGTAGCGCACCAGGTACTTCTACCGAACC<br>GTCCGAGGGTAGCGCACCAGGTAGCCCAGCAGGTTCTCCTACCTCCACCGAGGA<br>AGGTACTTCTACCGAACCGTCCGAGGGTAGCGCACCAGGTACCTCTGAAAGCGC<br>AACTCCTGAGTCTGGCCCAGGTAGCGAACCTGCTACCTCCGGCTCTGAGACTCC<br>AGGTACCTCTGAAAGCGCAACCCCGGAATCTGGTCCAGGTAGCGAACCTGCAAC<br>CTCTGGCTCTGAAACCCCAGGTACCTCTGAAAGCGCTACTCCTGAATCTGGCCC<br>AGGTACTTCTACTGAACCGTCCGAGGGCAGCGCACCAGGTACTTCTGAAAGCGC<br>TACTCCTGAGTCCGGCCCAGGTAGCCCGGCTGGCTCTCCGACTTCCACCGAGGA<br>AGGTAGCCCGGCTGGCTCTCCAACTTCTACTGAAGAAGGTAGCCCGGCAGGCTC<br>TCCGACTCTACTGAGGAAGGTACTTCTGAAAGCGCAACCCCGGAGTCCGGCCC<br>AGGTACCTCTACCGAACCGTCTGAGGGCAGCGCACCAGGTACCTCTGAAAGCGC<br>AACTCCTGAGTCTGGCCCAGGTAGCGAACCTGCTACCTCCGGCTCTGAGACTCC<br>AGGTACCTCTGAAAGCGCAACCCCGGAATCTGGTCCAGGTAGCGAACCTGCAAC<br>CTCTGGCTCTGAAACCCCAGGTACCTCTGAAAGCGCTACTCCTGAATCTGGCCC<br>AGGTACTTCTACTGAACCGTCCGAGGGCAGCGCACCAGGTAGCCCTGCTGGCTC<br>TCCAACCTCCACCGAAGAAGGTACCTCTGAAAGCGCAACCCCTGAATCCGGCCC<br>AGGTAGCGAACCGGCAACCTCCGGTTCTGAAACCCCAGGTACTTCTGAAAGCGC<br>TACTCCTGAGTCCGGCCCAGGTAGCCCGGCTGGCTCTCCGACTTCCACCGAGGA<br>AGGTAGCCCGGCTGGCTCTCCAACTTCTACTGAAGAAGGTACTTCTACCGAACC<br>TTCCGAGGGCAGCGCACCAGGTACTTCTGAAAGCGCTACCCCTGAGTCCGGCCC<br>AGGTACTTCTGAAAGCGCTACTCCTGAATCCGGTCCAGGTACTTCTGAAAGCGC<br>TACCCCGGAATCTGGCCCAGGTAGCGAACCGGCTACTTCTGGTTCTGAAACCCC<br>AGGTAGCGAACCGGCTACCTCCGGTTCTGAAACTCCAGGTAGCCCAGCAGGCTC<br>TCCGACTTCCACTGAGGAAGGTACTTCTACTGAACCTTCCGAAGGCAGCGCACC<br>AGGTACCTCTACTGAACCTTCTGAGGGCAGCGCTCCAGGTAGCGAACCTGCAAC<br>CTCTGGCTCTGAAACCCCAGGTACCTCTGAAAGCGCTACTCCTGAATCTGGCCC<br>AGGTACTTCTACTGAACCGTCCGAGGGCAGCGCACCA |
| AM1318 | 125 | GGTACTTCTACTGAACCGTCTGAAGGCAGCGCACCAGGTAGCGAACCGGCTACT<br>TCCGGTTCTGAAACCCCAGGTAGCCCAGCAGGTTCTCCAACTTCTACTGAAGAA<br>GGTTCTACCAGCTCTACCGCAGAATCTCCTGGTCCAGGTACCTCTACTCCGGAA<br>AGCGGCTCTGCATCTCCAGGTTCTACTAGCGAATCTCCTTCGGCACTGCACCAG<br>GTTCTACTAGCGAATCCCGTCTGGTACTGCTCCAGGTACTTCTACTCCTGAAAG<br>CGGTTCCGCTTCTCCAGGTACCTCTACTCCGGAAAGCGGTTCTGCATCTCCAGGT<br>AGCGAACCGGCAACCTCCGGCTCTGAAACCCCAGGTACCTCTGAAAGCGCTACT<br>CCTGAATCCGGCCCAGGTAGCCCGGCAGGTTCTCCGACTTCCACTGAGGAAGGT<br>ACCTCTACTGAACCTTCTGAGGGCAGCGCTCCAGGTACTTCTGAAAGCGCTACC<br>CCGGAGTCCGGTCCAGGTACTTCTACTGAACCGTCCGAAGGTAGCGCACCAGGT<br>ACTTCTACCGAACCGTCCGAGGGTAGCGCACCAGGTAGCCCAGCAGGTTCTCCT<br>ACCTCCACCGAGGAAGGTACTTCTACCGAACCGTCCGAGGGTAGCGCACCAGGT<br>ACTTCTACCGAACCTTCCGAGGGCAGCGCACCAGGTACTTCTGAAAGCGCTACC<br>CCTGAGTCCGGCCCAGGTACTTCTGAAAGCGCTACTCCTGAATCCGGTCCAGGT<br>ACCTCTACTGAACCTTCCGAAGGCAGCGCTCCAGGTACCTCTACCGAACCGTCC<br>GAGGGCAGCGCACCAGGTACTTCTGAAAGCGCAACCCCTGAATCCGGTCCAGGT<br>ACTTCTACTGAACCTTCCGAAGGTAGCGCTCCAGGTAGCGAACCTGCTACTTCT<br>GGTTCTGAAACCCCAGGTAGCCCGGCTGGCTCTCCGACCTCCACCGAGGAAGGT<br>AGCTCTACCCCGTCTGGTGCTACTGGTTCTCCAGGTACTCCGGGCAGCGGTACTG<br>CTTCTTCCTCTCCAGGTAGCTCTACCCCTTCTGGTGCTACTGGCTCTCAGGTAC<br>CTCTACCGAACCGTCCGAGGGTAGCGCACCAGGTACCTCTACTGAACCGTCTGA<br>GGGTAGCGCTCCAGGTAGCGAACCGGCAACCTCCGGTTCTGAAACTCCAGGTAG<br>CCCTGCTGGCTCTCCGACTTCTACTGAGGAAGGTAGCCCGGCTGGTTCTCCGACT<br>TCTACTGAGGAAGGTACTTCTACCGAACCTTCCGAAGGTAGCGCTCCAGGTCCA<br>GAACCAACGGGGCCGGCCCCAAGCGGAGGTAGCGAACCGGCAACCTCCGGCTC<br>TGAAACCCCAGGTACCTCTGAAAGCGCTACTCCTGAATCCGGCCCAGGTAGCCC<br>GGCAGGTTCTCCGACTTCCACTGAGGAAGGTACTTCTGAAAGCGCTACTCCTGA |

TABLE 8-continued

DNA sequences of XTEN and precursor sequences

| XTEN Name | SEQ ID NO: | DNA Nucleotide Sequence |
|---|---|---|
| | | GTCCGGCCCAGGTAGCCCGGCTGGCTCTCCGACTTCCACCGAGGAAGGTAGCCC
GGCTGGCTCTCCAACTTCTACTGAAGAAGGTACTTCTGAAAGCGCTACTCCTGA
GTCCGGCCCAGGTAGCCCGGCTGGCTCTCCGACTTCCACCGAGGAAGGTAGCCC
GGCTGGCTCTCCAACTTCTACTGAAGAAGGTTCTACCAGCTCTACCGCTGAATCT
CCTGGCCCAGGTTCTACTAGCGAATCTCCGTCTGGCACCGCACCAGGTACTTCCC
CTAGCGGTGAATCTTCTACTGCACCAGGTTCTACCAGCGAATCTCCTTCTGGCAC
CGCTCCAGGTTCTACTAGCGAATCCCCGTCTGGTACCGCACCAGGTACTTCTCCT
AGCGGCGAATCTTCTACCGCACCAGGTACTTCTACCGAACCTTCCGAGGGCAGC
GCACCAGGTACTTCTGAAAGCGCTACCCCTGAGTCCGGCCCAGGTACTTCTGAA
AGCGCTACTCCTGAATCCGGTCCAGGTAGCGAACCGGCAACCTCTGGCTCTGAA
ACCCCAGGTACCTCTGAAAGCGCTACTCCGGAATCTGGTCCAGGTACTTCTGAA
AGCGCTACTCCGGAATCCGGTCCAGGTACCTCTACTGAACCTTCTGAGGGCAGC
GCTCCAGGTACTTCTGAAAGCGCTACCCCGGAGTCCGGTCCAGGTACTTCTACT
GAACCGTCCGAAGGTAGCGCACCAGGTACCTCCCCTAGCGGCGAATCTTCTACT
GCTCCAGGTACCTCTCCTAGCGGCGAATCTTCTACCGCTCCAGGTACCTCCCCTA
GCGGTGAATCTTCTACCGCACCAGGTACTTCTACCGAACCGTCCGAGGGTAGCG
CACCAGGTAGCCCAGCAGGTTCTCCTACCTCCACCGAGGAAGGTACTTCTACCG
AACCGTCCGAGGGTAGCGCACCAGGTTCTAGCCCTTCTGCTTCACCGGTACCG
GCCCAGGTAGCTCTACTCCGTCTGGTGCAACTGGCTCTCCAGGTAGCTCTACTCC
GTCTGGTGCAACCGGCTCCCCAGGTAGCTCTACCCCGTCTGGTGCTACCGGCTCT
CCAGGTAGCTCTACCCCGTCTGGTGCAACCGGCTCCCCAGGTGCATCCCCGGGT
ACTAGCTCTACCGGTTCTCCAGGTGCAAGCGCAAGCGGCGCGCAAGCACGGG
AGGTACTTCTCCGAGCGGTGAATCTTCTACCGCACCAGGTTCTACTAGCTCTACC
GCTGAATCTCCGGGCCCAGGTACTTCTCGAGCGGTGAATCTTCTACTGCTCCAG
GTACCTCTGAAAGCGCTACTCCGGAGTCTGGCCCAGGTACCTCTACTGAACCGT
CTGAGGGTAGCGCTCCAGGTACTTCTACTGAACCGTCCGAAGGTAGCGCACCAG
GTTCTAGCCCTTCTGCATCTACTGGTACTGGCCCAGGTAGCTCTACTCCTTCTGG
TGCTACCGGCTCTCCAGGTGCTTCTCCGGGTACTAGCTCTACCGGTTCTCCAGGT
ACTTCTACTCCGGAAAGCGGTTCCGCATCTCCAGGTACTTCTCCTAGCGGTGAAT
CTTCTACTGCTCCAGGTACCTCTCCTAGCGGCGAATCTTCTACTGCTCCAGGTAC
TTCTGAAAGCGCAACCCCTGAATCCGGTCCAGGTAGCGAACCGGCTACTTCTGG
CTCTGAGACTCCAGGTACTTCTACCGAACCGTCCGAAGGTAGCGCACCAGGTTC
TACCAGCGAATCCCCTTCTGGTACTGCTCCAGGTTCTACCAGCGAATCCCCTTCT
GGCACCGCACCAGGTACTTCTACCCCTGAAAGCGGCTCCGCTTCTCCAGGTAGC
CCGGCAGGCTCTCCGACCTCTACTGAGGAAGGTACTTCTGAAAGCGCAACCCCG
GAGTCCGGCCCAGGTACCTCTACCGAACCGTCTGAGGGCAGCGCACCAGGTAGC
CCTGCTGGCTCTCAACCTCCACCGAAGAAGGTACCTCTGAAAGCGCAACCCCT
GAATCCGGCCCAGGTAGCGAACCGGCAACCTCCGGTTCTGAAACCCCAGGTAGC
TCTACCCCGTCTGGTGCTACCGGTTCCCAGGTGCTTCTCCTGGTACTAGCTCTA
CCGGTTCTCCAGGTAGCTCTACCCCGTCTGGTGCTACTGGCTCTCCAGGTTCTAC
TAGCGAATCCCCGTCTGGTACTGCTCCAGGTACTTCCCCTAGCGGTGAATCTTCT
ACTGCTCCAGGTTCTACCAGCTCTACCGCAGAATCTCCGGGTCCAGGTAGCTCT
ACCCCTTCTGGTGCAACCGGCTCTCCAGGTGCATCCCCGGGTACCAGCTCTACC
GGTTCTCCAGGTACTCCGGGTAGCGGTACCGCTTCTTCCTCTCCAGGTAGCCCTG
CTGGCTCTCCGACTTCTACTGAGGAAGGTAGCCCGGCTGTTCTCCGACTTCTAC
TGAGGAAGGTACTTCTACCGAACCTTCCGAAGGTAGCGCTCCA |
| BC864 | 126 | GGTACTTCCACCGAACCATCCGAACCAGGTAGCGCAGGTACTTCCACCGAACCA
TCCGAACCTGGCAGCGCAGGTAGCGAACCGGCAACCTCTGGTACTGAACCATCA
GGTAGCGGCGCATCCGAGCCTACCTCTACTGAACCAGGTAGCGAACCGGCTACC
TCCGGTACTGAGCCATCAGGTAGCGAACCGGCAACTTCCGGTACTGAACCATCA
GGTAGCGAACCGGCAACTTCCGGCACTGAACCATCAGGTAGCGGTGCATCTGAG
CCGACCTCTACTGAACCAGGTACTTCTACTGAACCATCTGAGCCGGGCAGCGCA
GGTAGCGAACCAGCTACTTCGGCACTGAACCATCAGGTACTTCTACTGAACCA
TCCGAACCAGGTAGCGCAGGTAGCGAACCTGCTACCTCTGGTACTGAGCCATCA
GGTAGCGAACCGGCTACCTCTGGTACTGAACCATCAGGTACTTCTACCGAACCA
TCCGAGCCTGGTAGCGCAGGTACTTCTACCGAACCATCCGAGCCAGGCAGCGCA
GGTAGCGAACCGGCAACCTCTGGCACTGAGCCATCAGGTAGCGAACCAGCAAC
TTCTGGTACTGAACCATCAGGTACTAGCGAGCCATCTACTTCCGAACCAGGTGC
AGGTAGCGGCGCATCCGAACCTACTTCCACTGAACCAGGTACTAGCGAGCCATC
CACCTCTGAACCAGGTGCAGGTAGCGAACCGGCAACTTCCGGCACTGAACCATC
AGGTAGCGAACCGGCTACCTCTGGTACTGAACCATCAGGTACTTCTACCGAACC
ATCCGAGCCTGGTAGCGCAGGTACTTCTACCGAACCATCCGAGCCAGGCAGCGC
AGGTAGCGGTGCATCCGAGCCGACCTCTACTGAACCAGGTAGCGAACCAGCAA
CTTCTGGCACTGAGCCATCAGGTAGCGAACCAGCTACCTCTGGTACTGAACCAT
CAGGTAGCGAACCGGCTACTTCCGGCACTGAACCATCAGGTAGCGAACCAGCA
ACCTCCGGTACTGAACCATCAGGTACTTCCACTGAACCATCCGAACCGGGTAGC
GCAGGTAGCGAACCGGCAACTTCCGGCACTGAACCATCAGGTAGCGGTGCATCT
GAGCCGACCTCTACTGAACCAGGTACTTCTACTGAACCATCTGAGCCGGGCAGC
GCAGGTAGCGAACCTGCAACCTCCGGCACTGAGCCATCAGGTAGCGAACCATCT
GAACCAACCTCTACTGAACCAGGTACTTCCACCGAACCATCTGAGCCAGGCAGC
GCAGGTAGCGGCGCATCTGAACCAACCTCTACTGAACCAGGTAGCGAACCAGC
AACTTCTGGTACTGAACCATCAGGTAGCGGCGCATCTGAGCCTACTTCCACTGA
ACCAGGTAGCGAACCGGCAACTTCCGGCACTGAACCATCAGGTAGCGGTGCATC
TGAGCCGACCTCTACTGAACCAGGTACTTCTACTGAACCATCTGAGCCGGGCAG |

TABLE 8-continued

DNA sequences of XTEN and precursor sequences

| XTEN Name | SEQ ID NO: | DNA Nucleotide Sequence |
|---|---|---|
| | | CGCAGGTAGCGAACCGGCAACTTCCGGCACTGAACCATCAGGTAGCGGTGCATC
TGAGCCGACCTCTACTGAACCAGGTACTTCTACTGAACCATCTGAGCCGGGCAG
CGCAGGTAGCGAACCAGCTACTTCTGGCACTGAACCATCAGGTACTTCTACTGA
ACCATCCGAACCAGGTAGCGCAGGTAGCGAACCTGCTACCTCTGGTACTGAGCC
ATCAGGTACTTCTACTGAACCATCCGAGCCGGGTAGCGCAGGTACTTCCACTGA
ACCATCTGAACCTGGTAGCGCAGGTACTTCCACTGAACCATCCGAACCAGGTAG
CGCAGGTACTTCTACTGAACCATCCGAGCCGGGTAGCGCAGGTACTTCCACTGA
ACCATCTGAACCTGGTAGCGCAGGTACTTCCACTGAACCATCCGAACCAGGTAG
CGCAGGTACTAGCGAACCATCCACCTCCGAACCAGGCGCAGGTAGCGGTGCATC
TGAACCGACTTCTACTGAACCAGGTACTTCCACTGAACCATCTGAGCCAGGTAG
CGCAGGTACTTCCACCGAACCATCCGAACCAGGTAGCGCAGGTACTTCCACCGA
ACCATCCGAACCTGGCAGCGCAGGTAGCGAACCGGCAACCTCTGGTACTGAACC
ATCAGGTAGCGGTGCATCCGAGCCGACCTCTACTGAACCAGGTAGCGAACCAGC
AACTTCTGGCACTGAGCCATCAGGTAGCGAACCAGCTACCTCTGGTACTGAACC
ATCAGGTAGCGAACCGGCAACCTCTGGCACTGAGCCATCAGGTAGCGAACCAG
CAACTTCTGGTACTGAACCATCAGGTACTAGCGAGCCATCTACTTCCGAACCAG
GTGCAGGTAGCGAACCTGCAACCTCCGGCACTGAGCCATCAGGTAGCGGCGCAT
CTGAACCAACCTCTACTGAACCAGGTACTTCCACCGAACCATCTGAGCCAGGCA
GCGCAGGTAGCGAACCTGCAACCTCCGGCACTGAGCCATCAGGTAGCGGCGCA
TCTGAACCAACCTCTACTGAACCAGGTACTTCCACCGAACCATCTGAGCCAGGC
AGCGCA |
| BD864 | 127 | GGTAGCGAAACTGCTACTTCCGGCTCTGAGACTGCAGGTACTAGTGAATCCGCA
ACTAGCGAATCTGGCGCAGGTAGCACTGCAGGCTCTGAGACTTCCACTGAAGCA
GGTACTAGCGAGTCCGCAACCAGCGAATCCGGCGCAGGTAGCGAAACTGCTAC
CTCTGGCTCCGAGACTGCAGGTAGCGAAACTGCAACCTCTGGCTCTGAAACTGC
AGGTACTTCCACTGAAGCAAGTGAAGGCTCCGCATCAGGTACTTCCACCGAAGC
AAGCGAAGGCTCCGCATCAGGTACTAGTGAGTCCGCAACTAGCGAATCCGGTGC
AGGTAGCGAAACCGCTACCTCTGGTTCCGAAACTGCAGGTACTTCTACCGAGGC
TAGCGAAGGTTCTGCATCAGGTAGCACTGCTGGTTCCGAGACTTCTACTGAAGC
AGGTACTAGCGAATCTGCTACTAGCGAATCCGGCGCAGGTACTAGCGAATCCGC
TACCAGCGAATCCGGCGCAGGTAGCGAAACTGCAACCTCTGGTTCCGAGACTGC
AGGTACTAGCGAGTCCGCTACTAGCGAATCTGGCGCAGGTACTTCCACTGAAGC
TAGTGAAGGTTCTGCATCAGGTAGCGAAACTGCTACTTCTGGTTCCGAAACTGC
AGGTAGCGAAACCGCTACCTCTGGTTCCGAAACTGCAGGTACTTCTACCGAGGC
TAGCGAAGGTTCTGCATCAGGTAGCACTGCTGGTTCCGAGACTTCTACTGAAGC
AGGTACTAGCGAGTCCGCTACTAGCGAATCTGGCGCAGGTACTTCCACTGAAGC
TAGTGAAGGTTCTGCATCAGGTAGCGAAACTGCTACTTCTGGTTCCGAAACTGC
AGGTAGCACTGCTGGCTCCGAGACTTCTACCGAAGCAGGTAGCACTGCAGGTTC
CGAAACTTCCACTGAAGCAGGTAGCGAAACTGCTACCTCTGGCTCTGAGACTGC
AGGTACTAGCGAATCTGCTACTAGCGAATCCGGCGCAGGTACTAGCGAATCCGC
TACCAGCGAATCCGGCGCAGGTAGCGAAACTGCAACCTCTGGTTCCGAGACTGC
AGGTACTAGCGAATCTGCTACTAGCGAATCCGGCGCAGGTACTAGCGAATCCGC
TACCAGCGAATCCGGCGCAGGTAGCGAAACTGCAACCTCTGGTTCCGAGACTGC
AGGTAGCGAAACCGCTACCTCTGGTTCCGAAACTGCAGGTACTTCTACCGAGGC
TAGCGAAGGTTCTGCATCAGGTAGCACTGCTGGTTCCGAGACTTCTACTGAAGC
AGGTAGCGAAACTGCTACTTCCGGCTCTGAGACTGCAGGTACTAGTGAATCCGC
AACTAGCGAATCTGGCGCAGGTAGCACTGCAGGCTCTGAGACTTCCACTGAAGC
AGGTAGCACTGCTGGTTCCGAAACCTCTACCGAAGCAGGTAGCACTGCAGGTTC
TGAAACCTCCACTGAAGCAGGTACTTCCACTGAGGCTAGTGAAGGCTCTGCATC
AGGTAGCACTGCTGGTTCCGAAACCTCTACCGAAGCAGGTAGCACTGCAGGTTC
TGAAACCTCCACTGAAGCAGGTACTTCCACTGAGGCTAGTGAAGGCTCTGCATC
AGGTAGCACTGCAGGTTCTGAGACTTCCACCGAAGCAGGTAGCGAAACTGCTAC
TTCTGGTTCCGAAACTGCAGGTACTTCCACTGAAGCTAGTGAAGGTTCCGCATC
AGGTACTAGTGAGTCCGCAACCAGCGAATCCGGCGCAGGTAGCGAAACCGCAA
CCTCCGGTTCTGAAACTGCAGGTACTAGCGAATCCGCAACCAGCGAATCTGGCG
CAGGTACTAGTGAGTCCGCAACCAGCGAATCCGGCGCAGGTAGCGAAACCGCA
ACCTCCGGTTCTGAAACTGCAGGTACTAGCGAATCCGCAACCAGCGAATCTGGC
GCAGGTAGCGAAACTGCTACTTCCGGCTCTGAGACTGCAGGTACTTCCACCGAA
GCAAGCGAAGGTTCCGCATCAGGTACTTCCACCGAGGCTAGTGAAGGCTCTGCA
TCAGGTAGCACTGCTGGCTCCGAGACTTCTACCGAAGCAGGTAGCACTGCAGGT
TCCGAAACTTCCACTGAAGCAGGTAGCGAAACTGCTACCTCTGGCTCTGAGACT
GCAGGTACTAGCGAATCTGCTACTAGCGAATCCGGCGCAGGTACTAGCGAATCC
GCTACCAGCGAATCCGGCGCAGGTAGCGAAACTGCAACCTCTGGTTCCGAGACT
GCAGGTAGCGAAACTGCTACTTCCGGCTCCGAGACTGCAGGTAGCGAAACTGCT
ACTTCTGGCTCCGAAACTGCAGGTACTTCTACTGAGGCTAGTGAAGGTTCCGCA
TCAGGTACTAGCGAGTCCGCAACCAGCGAATCCGGCGCAGGTAGCGAAACTGC
TACCTCTGGCTCCGAGACTGCAGGTAGCGAAACTGCAACCTCTGGCTCTGAAAC
TGCAGGTACTAGCGAATCTGCTACTAGCGAATCCGGCGCAGGTACTAGCGAATC
CGCTACCAGCGAATCCGGCGCAGGTAGCGAAACTGCAACCTCTGGTTCCGAGAC
TGCA |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferase, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization is performed using computer programs (Gustafsson, C., et al. (2004) *Trends Biotechnol,* 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in *E. coli*). In the case of *E. coli*, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene comprises one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence 5'-AGGTGCAAGCG-CAAGCGGCGCGCCAAGCACGGGAGGT-3' (SEQ ID NO: 128). In another embodiment, a sequencing island is the sequence 5'-AGGTCCAGAACCAACGGGGCCGGC-CCCAAGCGGAGGT-3' (SEQ ID NO: 129).

In one embodiment, polynucleotide libraries are constructed using the disclosed methods wherein all members of the library encode the same amino acid sequence but where codon usage for the respective amino acids in the sequence is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences allows some variation in amino acid sequence. For instance one can randomize some codons such that a number of hydrophilic amino acids can occur in a particular position. During the process of iterative multimerization one can screen the resulting library members for other characteristics like solubility or protease resistance in addition to a screen for high-level expression.

Once the gene that encodes the XTEN of desired length and properties is selected, it is genetically fused at the desired location to the nucleotides encoding the CF gene(s) by cloning it into the construct adjacent and in frame with the gene coding for CF, or alternatively between nucleotides encoding adjacent domains of the CF, or alternatively within a sequence encoding a given CF domain, or alternatively in frame with nucleotides encoding a spacer/cleavage sequence linked to a terminal XTEN. The invention provides various permutations of the foregoing, depending on the CFXTEN to be encoded. For example, a gene encoding a CFXTEN fusion protein comprising a CF and two XTEN, such as embodied by formula VI, as depicted above, the gene would have polynucleotides encoding CF, encoding two XTEN, which can be identical or different in composition and sequence length. In one non-limiting embodiment of the foregoing, the CF polynucleotides would encode coagulation factor and the polynucleotides encoding the C-terminus XTEN would encode AE864 and the polynucleotides encoding an internal XTEN adjacent to the C-terminus of EGF2 would encode AE144. The step of cloning the CF genes into the XTEN construct can occur through a ligation or multimerization step, as shown in FIG. 32. The constructs encoding CFXTEN fusion proteins can be designed in different configurations of the components XTEN, CF, and spacer sequences, such as the configurations of formulae I-VI. In one embodiment, the construct comprises polynucleotide sequences complementary to, or those that encode a monomeric polypeptide of components in the following order (5' to 3') CF and XTEN. In another embodiment, the construct comprises polynucleotide sequences complementary to, or those that encode a monomeric polypeptide of components in the following order (5' to 3') CF, spacer sequence, and XTEN. The spacer polynucleotides can optionally comprise sequences encoding cleavage sequences. As will be apparent to those of skill in the art, other permutations or multimers of the foregoing are possible.

The invention also encompasses polynucleotides comprising XTEN-encoding polynucleotide variants that have a high percentage of sequence identity compared to (a) a polynucleotide sequence from Table 8, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity compared to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology, 1970, 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the CFXTEN sequences under stringent conditions, such as those described herein.

The resulting polynucleotides encoding the CFXTEN chimeric fusion proteins can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated.

The invention provides for the use of plasmid vectors containing replication and control sequences that are compatible with and recognized by the host cell, and are operably linked to the CFXTEN gene for controlled expression of the CFXTEN fusion proteins. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the fusion protein in a suitable host. The requirements are that the vectors are replicable and viable in the host cell of choice. Low- or high-copy number vectors may be used as desired.

Other suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. Yeast expression systems that can also be used in the present invention include, but are not limited to, the non-fusion pYES2 vector (Invitrogen), the fusion pYESHisA, B, C (Invitrogen), pRS vectors and the like.

The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell.

Examples of suitable promoters for directing the transcription of the DNA encoding the CF polypeptide variant in mammalian cells are the SV40 promoter (Subramani et al., *Mol. Cell. Biol.* 1 (1981), 854-864), the MT-1 (metallothionein gene) promoter (Palmiter et al., *Science* 222 (1983), 809-814), the CMV promoter (Boshart et al., *Cell* 41:521-530, 1985) or the adenovirus 2 major late promoter (Kaufman and Sharp, *Mol. Cell. Biol,* 2:1304-1319, 1982). The vector may also carry sequences such as UCOE (ubiquitous chromatin opening elements).

Examples of suitable promoters for use in filamentous fungus host cells are, for instance, the ADH3 promoter or the tpiA promoter. Examples of other useful promoters are those derived from the gene encoding *A. oryzae* TAKA amylase, *Rhizomucor miehei* aspartic proteinase, *A. niger* neutral α-amylase, *A. niger* acid stable α-amylase, *A. niger* or *A. awamoriglucoamylase* (gluA), *Rhizomucor miehei* lipase, *A. oryzae* alkaline protease, *A. oryzae* triose phosphate isomerase or *A. nidulans* acetamidase. Preferred are the TAKA-amylase and gluA promoters.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all is operably linked to the DNA encoding CFXTEN polypeptides. Promoters for use in bacterial systems can also contain a Shine-Dalgarno (S.D.) sequence, operably linked to the DNA encoding CFXTEN polypeptides.

The invention contemplates use of other expression systems including, for example, a baculovirus expression system with both non-fusion transfer vectors, such as, but not limited to pVL941 Summers, et al., Virology 84:390-402 (1978)), pVL1393 (Invitrogen), pVL1392 (Summers, et al., Virology 84:390-402 (1978) and Invitrogen) and pBlueBacIII (Invitrogen), and fusion transfer vectors such as, but not limited to, pAc700 (Summers, et al., Virology 84:390-402 (1978)), pAc701 and pAc70-2 (same as pAc700, with different reading frames), pAc360 Invitrogen) and pBlueBacHisA, B, C (Invitrogen) can be used.

Examples of suitable promoters for directing the transcription of the DNA encoding the CF polypeptide variant in mammalian cells are the CMV promoter (Boshart et al., *Cell* 41:521-530, 1985), the SV40 promoter (Subramani et al.,

*Mol. Cell. Biol.* 1 (1981), 854-864), the MT-1 (metallothionein gene) promoter (Palmiter et al., *Science* 222 (1983), 809-814), the adenovirus 2 major late promoter (Kaufman and Sharp, *Mol. Cell. Biol,* 2:1304-1319, 1982). The vector may also carry sequences such as UCOE (ubiquitous chromatin opening elements).

Examples of suitable promoters for use in filamentous fungus host cells are, for instance, the ADH3 promoter or the tpiA promoter.

The DNA sequences encoding the CFXTEN may also, if necessary, be operably connected to a suitable terminator, such as the hGH terminator (Palmiter et al., *Science* 222, 1983, pp. 809-814) or the TPI1 terminators (Alber and Kawasaki, *J. Mol. Appl. Gen.* 1, 1982, pp. 419-434) or ADH3 (McKnight et al., *The EMBO J.* 4, 1985, pp. 2093-2099). Expression vectors may also contain a set of RNA splice sites located downstream from the promoter and upstream from the insertion site for the CFXTEN sequence itself, including splice sites obtained from adenovirus. Also contained in the expression vectors is a polyadenylation signal located downstream of the insertion site. Particularly preferred polyadenylation signals include the early or late polyadenylation signal from SV40 (Kaufman and Sharp, ibid.), the polyadenylation signal from the adenovirus 5 E1b region, the hGH terminator (DeNoto et al. Nucl. Acids Res. 9:3719-3730, 1981). The expression vectors may also include a noncoding viral leader sequence, such as the adenovirus 2 tripartite leader, located between the promoter and the RNA splice sites; and enhancer sequences, such as the SV40 enhancer.

To direct the CFXTEN of the present invention into the secretory pathway of the host cells, a secretory signal sequence (a.k.a., a leader sequence, a prepro sequence, or a pre sequence) may be included in the recombinant vector. The secretory signal sequence is operably linked to the DNA sequences encoding the CFXTEN, usually positioned 5' to the DNA sequence encoding the CFXTEN fusion protein. The secretory signal sequence may be that, normally associated with the protein or may be from a gene encoding another secreted protein. Non-limiting examples include OmpA, PhoA, and DsbA for *E. coli* expression, ppL-alpha, DEX4, invertase signal peptide, acid phosphatase signal peptide, CPY, or INU1 for yeast expression, and IL2L, SV40, IgG kappa and IgG lambda for mammalian expression. Signal sequences are typically proteolytically removed from the protein during the translocation and secretion process, generating a defined N-terminus. Methods are disclosed in Arnau, et al., Protein Expression and Purification 48: 1-13 (2006).

The procedures used to ligate the DNA sequences coding for the CFXTEN, the promoter and optionally the terminator and/or secretory signal sequence, respectively, and to insert them into suitable vectors containing the information necessary for replication, are well known to persons skilled in the art (cf., for instance, Sambrook et al., *Molecular Cloning: A Laboratory Manual*, Cold Spring Harbor, N.Y., 1989).

In other cases, the invention provides constructs and methods of making constructs comprising an polynucleotide sequence optimized for expression that encodes at least about 20 to about 60 amino acids with XTEN characteristics that can be included at the N-terminus of an XTEN carrier encoding sequence (in other words, the polynucleotides encoding the 20-60 encoded optimized amino acids are linked in frame to polynucleotides encoding an XTEN component that is N-terminal to CF) to promote the initiation of translation to allow for expression of XTEN fusions at the N-terminus of proteins without the presence of a helper domain. In an advantage of the foregoing, the sequence does not require subsequent cleavage, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity compared to AE912. In another embodiment of the foregoing, the optimized polynucleotide encodes an XTEN sequence with at least about 90% sequence identity compared to AM923. In another embodiment of the foregoing, the optimized polynucleotide encodes an XTEN sequence with at least about 90% sequence identity compared to AE48. In another embodiment of the foregoing, the optimized polynucleotide encodes an XTEN sequence with at least about 90% sequence identity compared to AM48. In one embodiment, the optimized polynucleotide NTS comprises a sequence that exhibits at least about 80%, at least about 85%, at least about 90%, at least about 91%, at least about 92%, at least about 93%, at least about 94%, at least about 95%, at least about 96%, at least about 97%, at least about 98%, or at least about 99%, sequence identity compared to a sequence or its complement selected from

```
                                            (SEQ ID NO: 130)
AE 48: 5'-

ATGGCTGAACCTGCTGGCTCTCCAACCTCCACTGAGGAAGGTACCCCGGG

TAGCGGTACTGCTTCTTCCTCTCCAGGTAGCTCTACCCCTTCTGGTGCAA

CCGGCTCTCCAGGTGCTTCTCCGGGCACCAGCTCTACCGGTTCTCCA-3'
and (SEQ ID NO: 131)
AM 48: 5'-

ATGGCTGAACCTGCTGGCTCTCCAACCTCCACTGAGGAAGGTGCATCCCC

GGGCACCAGCTCTACCGGTTCTCCAGGTAGCTCTACCCCGTCTGGTGCTA

CCGGCTCTCCAGGTAGCTCTACCCCGTCTGGTGCTACTGGCTCTCCA-3'
```

In this manner, a chimeric DNA molecule coding for a monomeric CFXTEN fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule.

Examples of mammalian cell lines for use in the present invention are the COS-1 (ATCC CRL 1650), COS-7 (ATCC CRL 1651), BHK-21 (ATCC CCL 10)) and BHK-293 (ATCC CRL 1573; Graham et al., *J. Gen. Virol.* 36:59-72, 1977), BHK-570 cells (ATCC CRL 10314), CHO-K1 (ATCC CCL 61), CHO-S (Invitrogen 11619-012), and 293-F (Invitrogen R790-7). A tk⁻ts13 BHK cell line is also available from the ATCC under accession number CRL 1632. In addition, a number of other cell lines may be used within the present invention, including Rat Hep I (Rat hepatoma; ATCC CRL 1600), Rat Hep II (Rat hepatoma; ATCC CRL 1548), TCMK (ATCC CCL 139), Human lung (ATCC HB 8065), NCTC 1469 (ATCC CCL 9.1), CHO (ATCC CCL 61) and DUKX cells (Urlaub and Chasin, *Proc. Natl. Acad. Sci. USA* 77:4216-4220, 1980).

Examples of suitable yeasts cells include cells of *Saccharomyces* spp. or *Schizosaccharomyces* spp., in particular strains of *Saccharomyces cerevisiae* or *Saccharomyces kluyveri*. Methods for transforming yeast cells with heterologous DNA and producing heterologous polypeptides there from are described, e.g. in U.S. Pat. No. 4,599,311, U.S. Pat. No. 4,931,373, U.S. Pat. Nos. 4,870,008, 5,037,743, and U.S. Pat. No. 4,845,075, all of which are hereby incorporated by reference. Transformed cells are selected by a phenotype determined by a selectable marker, commonly drug resistance or the ability to grow in the absence of a particular nutrient, e.g. leucine. A preferred vector for use in yeast is the POT1 vector disclosed in U.S. Pat. No. 4,931,373. The DNA sequences encoding the CFXTEN may be preceded by a signal sequence and optionally a leader sequence, e.g. as described above. Further examples of suitable yeast cells are strains of *Kluyveromyces*, such as *K. lactis, Hansenula*, e.g. *H. polymorpha*, or *Pichia*, e.g. *P. pastoris* (cf. Gleeson et al., *J. Gen. Microbiol.* 132, 1986, pp. 3459-3465; U.S. Pat. No. 4,882,279). Examples of other fungal cells are cells of filamentous fungi, e.g. *Aspergillus* spp., *Neurospora* spp., *Fusarium* spp. or *Trichoderma* spp., in particular strains of *A. oryzae, A. nidulans* or *A. niger*. The use of *Aspergillus* spp. for the expression of proteins is described in, e.g., EP 272 277, EP 238 023, EP 184 438 The transformation of *F. oxysporum* may, for instance, be carried out as described by Malardier et al., 1989, *Gene* 78: 147-156. The transformation of *Trichoderma* spp. may be performed for instance as described in EP 244 234.

Other suitable cells that can be used in the present invention include, but are not limited to, prokaryotic host cells strains such as *Escherichia coli*, (e.g., strain DH5-α), *Bacillus subtilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma*; and *Vibrio*.

Methods of transfecting mammalian cells and expressing DNA sequences introduced in the cells are described in e.g., Kaufman and Sharp, *J. Mol. Biol.* 159 (1982), 601-621; Southern and Berg, *J. Mol. Appl. Genet.* 1 (1982), 327-341; Loyter et al., *Proc. Natl. Acad. Sci. USA* 79 (1982), 422-426; Wigler et al., *Cell* 14 (1978), 725; Corsaro and Pearson, *Somatic Cell Genetics* 7 (1981), 603, Graham and van der Eb, *Virology* 52 (1973), 456; and Neumann et al., *EMBO J.* 1 (1982), 841-845.

Cloned DNA sequences are introduced into cultured mammalian cells by, for example, calcium phosphate-mediated transfection (Wigler et al., Cell 14:725-732, 1978; Corsaro and Pearson, Somatic Cell Genetics 7:603-616, 1981; Graham and Van der Eb, Virology 52d:456-467, 1973), transfection with many commercially available reagents such as FuGENEG Roche Diagnostics, Mannheim, Germany) or lipofectamine (Invitrogen) or by electroporation (Neumann et al., EMBO J. 1:841-845, 1982). To identify and select cells that express the exogenous DNA, a gene that confers a selectable phenotype (a selectable marker) is generally introduced into cells along with the gene or cDNA of interest. Preferred selectable markers include genes that confer resistance to drugs such as neomycin, hygromycin, puromycin, zeocin, and methotrexate. The selectable marker may be an amplifiable selectable marker. A preferred amplifiable selectable marker is a dihydrofolate reductase (DHFR) sequence. Further examples of selectable markers are well known to one of skill in the art and include reporters such as enhanced green fluorescent protein (EGFP), beta-galactosidase (β-gal) or chloramphenicol acetyltransferase (CAT). Selectable markers are reviewed by Thilly (Mammalian Cell Technology, Butterworth Publishers, Stoneham, Mass., incorporated herein by reference). The person skilled in the art will easily be able to choose suitable selectable markers. Any known selectable marker may be employed so long as it is capable of being expressed simultaneously with the nucleic acid encoding a gene product.

Selectable markers may be introduced into the cell on a separate plasmid at the same time as the gene of interest, or they may be introduced on the same plasmid. If, on the same plasmid, the selectable marker and the gene of interest may be under the control of different promoters or the same promoter, the latter arrangement producing a dicistronic message. Constructs of this type are known in the art (for example, Levinson and Simonsen, U.S. Pat. No. 4,713,339). It may also be advantageous to add additional DNA, known as "carrier DNA," to the mixture that is introduced into the cells.

After the cells have taken up the DNA, they are grown in an appropriate growth medium, typically 1-2 days, to begin expressing the gene of interest. As used herein the term "appropriate growth medium" means a medium containing nutrients and other components required for the growth of cells and the expression of the CFXTEN of interest. Media generally include a carbon source, a nitrogen source, essential amino acids, essential sugars, vitamins, salts, phospholipids, protein and growth factors. For production of gamma-carboxylated proteins, the medium will contain vitamin K, preferably at a concentration of about 0.1 μg/ml to about 5 μg/ml. Drug selection is then applied to select for the growth of cells that are expressing the selectable marker in a stable fashion. For cells that have been transfected with an amplifiable selectable marker the drug concentration may be increased to select for an increased copy number of the cloned sequences, thereby increasing expression levels. Clones of stably transfected cells are then screened for expression of the CF polypeptide variant of interest.

The transformed or transfected host cell is then cultured in a suitable nutrient medium under conditions permitting expression of the CF polypeptide variant after which the resulting peptide may be recovered from the culture. The medium used to culture the cells may be any conventional medium suitable for growing the host cells, such as minimal or complex media containing appropriate supplements. Suitable media are available from commercial suppliers or may be prepared according to published recipes (e.g. in catalogues of the American Type Culture Collection). The culture conditions, such as temperature, pH and the like, are those previously used with the host cell selected for expression, and will be apparent to the ordinarily skilled artisan.

Gene expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence CF polypeptide or against a synthetic peptide based on the DNA sequences provided herein or against exogenous sequence fused to CF and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

Expressed CFXTEN polypeptide product(s) may be purified via methods known in the art or by methods disclosed herein. Procedures such as gel filtration, affinity purification (e.g., using an anti-CF antibody column), salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Additional purification may be achieved by conventional chemical purification means, such as high performance liquid chromatography. Some expressed CFXTEN may require refolding during isolation and purification. Methods of purification are described in Robert K. Scopes, Protein Purification: Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679: 67-83 (1994). For therapeutic purposes it is preferred that the CFXTEN fusion proteins of the invention are substantially pure. Thus, in a preferred embodiment of the invention the CFXTEN of the invention is purified to at least about 90 to 95% homogeneity, preferably to at least about 98% homogeneity. Purity may be assessed by, e.g., gel electrophoresis, HPLC, and amino-terminal amino acid sequencing.

VIII). Pharmaceutical Compositions

The present invention provides pharmaceutical compositions comprising CFXTEN. In one embodiment, the pharmaceutical composition comprises the CFXTEN fusion protein and at least one pharmaceutically acceptable carrier. CFXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions.

The pharmaceutical compositions can be administered orally, intranasally, parenterally or by inhalation therapy, and may take the form of tablets, lozenges, granules, capsules, pills, ampoules, suppositories or aerosol form. They may also take the form of suspensions, solutions and emulsions of the active ingredient in aqueous or nonaqueous diluents, syrups, granulates or powders. In addition, the pharmaceutical compositions can also contain other pharmaceutically active compounds or a plurality of compounds of the invention.

More particularly, the present pharmaceutical compositions may be administered for therapy by any suitable route including oral, rectal, nasal, topical (including transdermal, aerosol, buccal and sublingual), vaginal, parenteral (including subcutaneous, subcutaneous by infusion pump, intramuscular, intravenous and intradermal), intravitreal, and pulmonary. It will also be appreciated that the preferred route will vary with the condition and age of the recipient, and the disease being treated.

In one embodiment, the pharmaceutical composition is administered subcutaneously. In this embodiment, the composition may be supplied as a lyophilized powder to be reconstituted prior to administration. The composition may also be supplied in a liquid form, which can be administered directly to a patient. In one embodiment, the composition is supplied as a liquid in a pre-filled syringe such that a patient can easily self-administer the composition.

Extended release formulations useful in the present invention may be oral formulations comprising a matrix and a coating composition. Suitable matrix materials may include waxes (e.g., carnauba, bees wax, paraffin wax, ceresine, shellac wax, fatty acids, and fatty alcohols), oils, hardened oils or fats (e.g., hardened rapeseed oil, castor oil, beef tallow, palm oil, and soya bean oil), and polymers (e.g., hydroxypropyl cellulose, polyvinylpyrrolidone, hydroxypropyl methyl cellulose, and polyethylene glycol). Other suitable matrix tabletting materials are microcrystalline cellulose, powdered cellulose, hydroxypropyl cellulose, ethyl cellulose, with other carriers, and fillers. Tablets may also contain granulates, coated powders, or pellets. Tablets may also be multi-layered. Multi-layered tablets are especially preferred when the active ingredients have markedly different pharmacokinetic profiles. Optionally, the finished tablet may be coated or uncoated.

The coating composition may comprise an insoluble matrix polymer and/or a water soluble material. Water soluble materials can be polymers such as polyethylene glycol, hydroxypropyl cellulose, hydroxypropyl methyl cellulose, polyvinylpyrrolidone, polyvinyl alcohol, or monomeric materials such as sugars (e.g., lactose, sucrose, fructose, mannitol and the like), salts (e.g., sodium chloride, potassium chloride and the like), organic acids (e.g., fumaric acid, succinic acid, lactic acid, and tartaric acid), and mixtures thereof Optionally, an enteric polymer may be incorporated into the coating composition. Suitable enteric polymers include hydroxypropyl methyl cellulose, acetate succinate, hydroxypropyl methyl cellulose, phthalate, polyvinyl acetate phthalate, cellulose acetate phthalate, cellulose acetate trimellitate, shellac, zein, and polymethacrylates containing carboxyl groups. The coating composition may be plasticised by adding suitable plasticisers such as, for example, diethyl phthalate, citrate esters, polyethylene glycol, glycerol, acetylated glycerides, acetylated citrate esters, dibutylsebacate, and castor oil. The coating composition may also include a filler, which can be an insoluble material such as silicon dioxide, titanium dioxide, talc, kaolin, alumina, starch, powdered cellulose, MCC, or polacrilin potassium. The coating composition may be applied as a solution or latex in organic solvents or aqueous solvents or mixtures thereof. Solvents such as water, lower alcohol, lower chlorinated hydrocarbons, ketones, or mixtures thereof may be used.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (non-polar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126,966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phasphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy)propyl]-N,N-dimethyl-N-hydroxyethylammonium bromide (DMRIE); N-[1-(2,3,-dioleyloxy)propyl]-N,N-dimethyl-N-hydroxy ethylammonium bromide (DORIE); N-[1-(2,3-dioleyloxy)propyl]-N,N,N-trimethylammonium chloride (DOTMA); 3[N-(N',N'-dimethylaminoethane) carbamoly] cholesterol (DC-Chol); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294,191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64:194-195 (1975)). Examples of suitable patches are passive transfer skin patches, iontophoretic skin patches, or patches with microneedles such as Nicoderm.

In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660,848; and 5,756,115.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

IX). Pharmaceutical Kits

In another aspect, the invention provides a kit to facilitate the use of the CFXTEN polypeptides. The kit comprises the pharmaceutical composition provided herein, a label identifying the pharmaceutical composition, and an instruction for storage, reconstitution and/or administration of the pharmaceutical compositions to a subject. In some embodiment, the kit comprises, preferably: (a) an amount of a CFXTEN fusion protein composition sufficient to treat a disease, condition or disorder upon administration to a subject in need thereof; and (b) an amount of a pharmaceutically acceptable carrier; together in a formulation ready for injection or for reconstitution with sterile water, buffer, or dextrose; together with a label identifying the CFXTEN drug and storage and handling conditions, and a sheet of the approved indications for the drug, instructions for the reconstitution and/or administration of the CFXTEN drug for the use for the prevention and/or treatment of a approved indication, appropriate dosage and safety information, and information identifying the lot and expiration of the drug. In another embodiment of the foregoing, the kit can comprise a second container that can carry a suitable diluent for the CFXTEN composition, the use of which will provide the user with the appropriate concentration of CFXTEN to be delivered to the subject.

EXAMPLES

Example 1

Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence [X]$_3$ where X is a 12mer peptide with the sequences: GESPGGSSGSES (SEQ ID NO: 31), GSEGSSGPGESS (SEQ ID NO: 32), GSSESGSSEGGP (SEQ ID NO: 33), or GSGGEPSESGSS (SEQ ID NO: 34).

The insert was obtained by annealing the following pairs of phosphorylated synthetic oligonucleotide pairs:

```
                                             (SEQ ID NO: 132)
AD1for:  AGGTGAATCTCCDGGTGGYTCYAGCGGTTCYGARTC (SEQ ID NO: 133)
AD1rev:  ACCTGAYTCRGAACCGCTRGARCCACCHGGAGATTC (SEQ ID NO: 134)
AD2for:  AGGTAGCGAAGGTTCTTCYGGTCCDGGYGARTCYTC (SEQ ID NO: 135)
AD2rev:  ACCTGARGAYTCRCCHGGACCRGAAGAACCTTCGCT (SEQ ID NO: 136)
AD3for:  AGGTTCYTCYGAAAGCGGTTCTTCYGARGGYGGTCC (SEQ ID NO: 137)
AD3rev:  ACCTGGACCRCCYTCRGAAGAACCGCTTTCRGARGA (SEQ ID NO: 138)
AD4for:  AGGTTCYGGTGGYGAACCDTCYGARTCTGGTAGCTC
```

We also annealed the phosphorylated oligonucleotide 3KpnIstopperFor: AGGTTCGTCTTCACTCGAGGGTAC (SEQ ID NO: 139) and the non-phosphorylated oligonucleotide pr_3KpnIstopperRev: CCTCGAGTGAAGACGA (SEQ ID NO: 140). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stiffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs for these segments are listed in Table 9.

TABLE 9

DNA and Amino Acid Sequences for 36-mer motifs

| File name | Amino acid sequence | SEQ ID NO: | Nucleotide sequence | SEQ ID NO: |
|---|---|---|---|---|
| LCW0401_001_GFP-N_A01.ab1 | GSGGEPSESGSSGESPGG SSGSESGESPGGSSGSES | 141 | GGTTCTGGTGGCGAACCGTCCGAGTC TGGTAGCTCAGGTGAATCTCCGGGTG GCTCTAGCGGTTCCGAGTCAGGTGAA TCTCCTGGTGGTTCCAGCGGTTCCGA GTCA | 142 |
| LCW0401_002_GFP-N_B01.ab1 | GSEGSSGPGESSGESPGG SSGSESGSSESGSSEGGP | 143 | GGTAGCGAAGGTTCTTCTGGTCCTGG CGAGTCTTCAGGTGAATCTCCTGGTG GTTCCAGCGGTTCTGAATCAGGTTCC TCCGAAAGCGGTTCTTCCGAGGGCG GTCCA | 144 |
| LCW0401_003_GFP-N_C01.ab1 | GSSESGSSEGGPGSSESG SSEGGPGESPGGSSGSES | 145 | GGTTCCTCTGAAAGCGGTTCTTCCGA AGGTGGTCCAGGTTCCTCTGAAAGCG GTTCTTCTGAGGGTGGTCCAGGTGAA TCTCCGGGTGGCTCCAGCGGTTCCGA GTCA | 146 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_004_GFP-N_D01.ab1 | GSGGEPSESGSSGSSESG SSEGGPGSGGEPSESGSS | 147 | GGTTCCGGTGGCGAACCGTCTGAATC TGGTAGCTCAGGTTCTTCTGAAAGCG GTTCTTCCGAGGGTGGTCCAGGTTCT GGTGGTGAACCTTCCGAGTCTGGTAG CTCA | 148 |
| LCW0401_007_GFP-N_F01.ab1 | GSSESGSSEGGPGSEGSS GPGESSGSEGSSGPGESS | 149 | GGTTCTTCCGAAAGCGGTTCTTCTGA GGGTGGTCCAGGTAGCGAAGGTTCTT CCGGTCCAGGTGAGTCTTCAGGTAGC GAAGGTTCTTCTGGTCCTGGTGAATC TTCA | 150 |
| LCW0401_008_GFP-N_G01.ab1 | GSSESGSSEGGPGESPGG SSGSESGSEGSSGPGESS | 151 | GGTTCCTCTGAAAGCGGTTCTTCCGA GGGTGGTCCAGGTGAATCTCCAGGT GGTTCCAGCGGTTCTGAGTCAGGTAG CGAAGGTTCTTCTGGTCCAGGTGAAT CCTCA | 152 |
| LCW0401_012_GFP-N_H01.ab1 | GSGGEPSESGSSGSGGEP SESGSSGSEGSSGPGESS | 153 | GGTTCTGGTGGTGAACCGTCTGAGTC TGGTAGCTCAGGTTCCGGTGGCGAAC CATCCGAATCTGGTAGCTCAGGTAGC GAAGGTTCTTCCGGTCCAGGTGAGTC TTCA | 154 |
| LCW0401_015_GFP-N_A02.ab1 | GSSESGSSEGGPGSEGSS GPGESSGESPGGSSGSES | 155 | GGTTCTTCCGAAAGCGGTTCTTCCGA AGGCGGTCCAGGTAGCGAAGGTTCT TCTGGTCCAGGCGAATCTTCAGGTGA ATCTCCTGGTGGCTCCAGCGGTTCTG AGTCA | 156 |
| LCW0401_016_GFP-N_B02.ab1 | GSSESGSSEGGPGSSESG SSEGGPGSSESGSSEGGP | 157 | GGTTCCTCCGAAAGCGGTTCTTCTGA GGGCGGTCCAGGTTCCTCCGAAAGC GGTTCTTCCGAGGGCGGTCCAGGTTC TTCTGAAAGCGGTTCTTCCGAGGGCG GTCCA | 158 |
| LCW0401_020_GFP-N_E02.ab1 | GSGGEPSESGSSGSEGSS GPGESSGSSESGSSEGGP | 159 | GGTTCCGGTGGCGAACCGTCCGAATC TGGTAGCTCAGGTAGCGAAGGTTCTT CTGGTCCAGGCGAATCTTCAGGTTCC TCTGAAAGCGGTTCTTCTGAGGGCGG TCCA | 160 |
| LCW0401_022_GFP-N_F02.ab1 | GSGGEPSESGSSGSSESG SSEGGPGSGGEPSESGSS | 161 | GGTTCTGGTGGTGAACCGTCCGAATC TGGTAGCTCAGGTTCTTCCGAAAGCG GTTCTTCTGAAGGTGGTCCAGGTTCC GGTGGCGAACCTTCTGAATCTGGTAG CTCA | 162 |
| LCW0401_024_GFP-N_G02.ab1 | GSGGEPSESGSSGSSESG SSEGGPGESPGGSSGSES | 163 | GGTTCTGGTGGCGAACCGTCCGAATC TGGTAGCTCAGGTTCCTCCGAAAGCG GTTCTTCTGAAGGTGGTCCAGGTGAA TCTCCAGGTGGTTCTAGCGGTTCTGA ATCA | 164 |
| LCW0401_026_GFP-N_H02.ab1 | GSGGEPSESGSSGESPGG SSGSESGSEGSSGPGESS | 165 | GGTTCTGGTGGCGAACCGTCTGAGTC TGGTAGCTCAGGTGAATCTCCTGGTG GCTCCAGCGGTTCTGAATCAGGTAGC GAAGGTTCTTCTGGTCCTGGTGAATC TTCA | 166 |
| LCW0401_027_GFP-N_A03.ab1 | GSGGEPSESGSSGESPGG SSGSESGSGGEPSESGSS | 167 | GGTTCCGGTGGCGAACCTTCCGAATC TGGTAGCTCAGGTGAATCTCCGGGTG GTTCTAGCGGTTCTGAGTCAGGTTCT GGTGGTGAACCTTCCGAGTCTGGTAG CTCA | 168 |
| LCW0401_028_GFP-N_B03.ab1 | GSSESGSSEGGPGSSESG SSEGGPGSSESGSSEGGP | 169 | GGTTCCTCTGAAAGCGGTTCTTCTGA GGGCGGTCCAGGTTCTTCCGAAAGC GGTTCTTCCGAGGGCGGTCCAGGTTC TTCCGAAAGCGGTTCTTCTGAAGGCG GTCCA | 170 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_030_GFP-N_C03.ab1 | GESPGGSSGSESGSEGSS GPGESSGSEGSSGPGESS | 171 | GGTGAATCTCCGGGTGGCTCCAGCG GTTCTGAGTCAGGTAGCGAAGGTTCT TCCGGTCCGGGTGAGTCCTCAGGTAG CGAAGGTTCTTCCGGTCCTGGTGAGT CTTCA | 172 |
| LCW0401_031_GFP-N_D03.ab1 | GSGGEPSESGSSGSGGEP SESGSSGSSESGSSEGGP | 173 | GGTTCTGGTGGCGAACCTTCCGAATC TGGTAGCTCAGGTTCCGGTGGTGAAC CTTCTGAATCTGGTAGCTCAGGTTCT TCTGAAAGCGGTTCTTCCGAGGGCGG TCCA | 174 |
| LCW0401_033_GFP-N_E03.ab1 | GSGGEPSESGSSGSGGEP SESGSSGSGGEPSESGSS | 175 | GGTTCCGGTGGTGAACCTTCTGAATC TGGTAGCTCAGGTTCCGGTGGCGAAC CATCCGAGTCTGGTAGCTCAGGTTCC GGTGGTGAACCATCCGAGTCTGGTA GCTCA | 176 |
| LCW0401_037_GFP-N_F03.ab1 | GSGGEPSESGSSGSSESG SSEGGPGSEGSSGPGESS | 177 | GGTTCCGGTGGCGAACCTTCTGAATC TGGTAGCTCAGGTTCCTCCGAAAGCG GTTCTTCTGAGGGCGGTCAGGTAGC GAAGGTTCTTCTGGTCCGGGCGAGTC TTCA | 178 |
| LCW0401_038_GFP-N_G03.ab1 | GSGGEPSESGSSGSEGSS GPGESSGSGGEPSESGSS | 179 | GGTTCCGGTGGTGAACCGTCCGAGTC TGGTAGCTCAGGTAGCGAAGGTTCTT CTGGTCCGGGTGAGTCTTCAGGTTCT GGTGGCGAACCGTCCGAATCTGGTA GCTCA | 180 |
| LCW0401_039_GFP-N_H03.ab1 | GSGGEPSESGSSGESPGG SSGSESGSGGEPSESGSS | 181 | GGTTCTGGTGGCGAACCGTCCGAATC TGGTAGCTCAGGTGAATCTCCTGGTG GTTCCAGCGGTTCCGAGTCAGGTTCT GGTGGCGAACCTTCCGAATCTGGTAG CTCA | 182 |
| LCW0401_040_GFP-N_A04.ab1 | GSSESGSSEGGPGSGGEP SESGSSGSSESGSSEGGP | 183 | GGTTCTTCCGAAAGCGGTTCTTCCGA GGGCGGTCCAGGTTCCGGTGGTGAA CCATCTGAATCTGGTAGCTCAGGTTC TTCTGAAAGCGGTTCTTCTGAAGGTG GTCCA | 184 |
| LCW0401_042_GFP-N_C04.ab1 | GSEGSSGPGESSGESPGG SSGSESGSEGSSGPGESS | 185 | GGTAGCGAAGGTTCTTCCGGTCCTGG TGAGTCTTCAGGTGAATCTCCAGGTG GCTCTAGCGGTTCCGAGTCAGGTAGC GAAGGTTCTTCTGGTCCTGGCGAGTC CTCA | 186 |
| LCW0401_046_GFP-N_D04.ab1 | GSSESGSSEGGPGSSESG SSEGGPGSSESGSSEGGP | 187 | GGTTCCTCTGAAAGCGGTTCTTCCGA AGGCGGTCCAGGTTCTTCCGAAAGC GGTTCTTCTGAGGGCGGTCCAGGTTC CTCCGAAAGCGGTTCTTCTGAGGGTG GTCCA | 188 |
| LCW0401_047_GFP-N_E04.ab1 | GSGGEPSESGSSGESPGG SSGSESGESPGGSSGSES | 189 | GGTTCTGGTGGCGAACCTTCCGAGTC TGGTAGCTCAGGTGAATCTCCGGGTG GTTCTAGCGGTTCCGAGTCAGGTGAA TCTCCGGGTGGTTCCAGCGGTTCTGA GTCA | 190 |
| LCW0401_051_GFP-N_F04.ab1 | GSGGEPSESGSSGSEGSS GPGESSGESPGGSSGSES | 191 | GGTTCTGGTGGCGAACCATCTGAGTC TGGTAGCTCAGGTAGCGAAGGTTCTT CCGGTCCAGGCGAGTCTTCAGGTGA ATCTCCTGGTGGCTCCAGCGGTTCTG AGTCA | 192 |
| LCW0401_053_GFP-N_H04.ab1 | GESPGGSSGSESGSESPGG SSGSESGESPGGSSGSES | 193 | GGTGAATCTCCTGGTGGTTCCAGCGG TTCCGAGTCAGGTGAATCTCCAGGTG GCTCTAGCGGTTCCGAGTCAGGTGAA TCTCCTGGTGGTTCTAGCGGTTCTGA ATCA | 194 |
| LCW0401_054_GFP-N_A05.ab1 | GSEGSSGPGESSGSEGSS GPGESSGSGGEPSESGSS | 195 | GGTAGCGAAGGTTCTTCCGGTCCAGG TGAATCTTCAGGTAGCGAAGGTTCTT | 196 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| | | | CTGGTCCTGGTGAATCCTCAGGTTCC GGTGGCGAACCATCTGAATCTGGTA GCTCA | |
| LCW0401_059_GFP-N_D05.ab1 | GSGGEPSESGSSGSEGSS GPGESSGESPGGSSGSES | 197 | GGTTCTGGTGGCGAACCATCCGAATC TGGTAGCTCAGGTAGCGAAGGTTCTT CTGGTCCTGGCGAATCTTCAGGTGAA TCTCCAGGTGGCTCTAGCGGTTCCGA ATCA | 198 |
| LCW0401_060_GFP-N_E05.ab1 | GSGGEPSESGSSGSSESG SSEGGPGSGGEPSESGSS | 199 | GGTTCCGGTGGTGAACCGTCCGAATC TGGTAGCTCAGGTTCCTCTGAAAGCG GTTCTTCCGAGGGTGGTCCAGGTTCC GGTGGTGAACCTTCTGAGTCTGGTAG CTCA | 200 |
| LCW0401_061_GFP-N_F05.ab1 | GSSESGSSEGGPGSGGEP SESGSSGSEGSSGPGESS | 201 | GGTTCCTCTGAAAGCGGTTCTTCTGA GGGCGGTCCAGGTTCTGGTGGCGAA CCATCTGAATCTGGTAGCTCAGGTAG CGAAGGTTCTTCCGGTCCGGGTGAAT CTTCA | 202 |
| LCW0401_063_GFP-N_H05.ab1 | GSGGEPSESGSSGSEGSS GPGESSGSEGSSGPGESS | 203 | GGTTCTGGTGGTGAACCGTCCGAATC TGGTAGCTCAGGTAGCGAAGGTTCTT CTGGTCCTGGCGAGTCTTCAGGTAGC GAAGGTTCTTCTGGTCCTGGTGAATC TTCA | 204 |
| LCW0401_066_GFP-N_B06.ab1 | GSGGEPSESGSSGSSESG SSEGGPGSGGEPSESGSS | 205 | GGTTCTGGTGGCGAACCATCCGAGTC TGGTAGCTCAGGTTCTTCCGAAAGCG GTTCTTCCGAAGGCGGTCCAGGTTCT GGTGGTGAACCGTCCGAATCTGGTA GCTCA | 206 |
| LCW0401_067_GFP-N_C06.ab1 | GSGGEPSESGSSGESPGG SSGSESGESPGGSSGSES | 207 | GGTTCCGGTGGCGAACCTTCCGAATC TGGTAGCTCAGGTGAATCTCCGGGTG GTTCTAGCGGTTCCGAATCAGGTGAA TCTCCAGGTGGTTCTAGCGGTTCCGA ATCA | 208 |
| LCW0401_069_GFP-N_D06.ab1 | GSGGEPSESGSSGSGGEP SESGSSGESPGGSSGSES | 209 | GGTTCCGGTGGTGAACCATCTGAGTC TGGTAGCTCAGGTTCCGGTGGCGAAC CGTCCGAGTCTGGTAGCTCAGGTGAA TCTCCGGGTGGTTCCAGCGGTTCCGA ATCA | 210 |
| LCW0401_070_GFP-N_E06.ab1 | GSEGSSGPGESSGSSESG SSEGGPGSEGSSGPGESS | 211 | GGTAGCGAAGGTTCTTCTGGTCCGGG CGAATCCTCAGGTTCCTCCGAAAGCG GTTCTTCCGAAGGTGGTCCAGGTAGC GAAGGTTCTTCCGGTCCTGGTGAATC TTCA | 212 |
| LCW0401_078_GFP-N_F06.ab1 | GSSESGSSEGGPGESPGG SSGSESGESPGGSSGSES | 213 | GGTTCCTCTGAAAGCGGTTCTTCTGA AGGCGGTCCAGGTGAATCTCCGGGT GGCTCCAGCGGTTCTGAATCAGGTGA ATCTCCTGGTGGCTCCAGCGGTTCCG AGTCA | 214 |
| LCW0401_079_GFP-N_G06.ab1 | GSEGSSGPGESSGSEGSS GPGESSGSGGEPSESGSS | 215 | GGTAGCGAAGGTTCTTCTGGTCCAGG CGAGTCTTCAGGTAGCGAAGGTTCTT CCGGTCCTGGCGAGTCTTCAGGTTCC GGTGGCGAACCGTCCGAATCTGGTA GCTCA | 216 |

Example 2

Construction of XTEN_AE36 Segments

A codon library encoding XTEN sequences of 36 amino acid length was constructed. The XTEN sequence was designated XTEN_AE36. Its segments have the amino acid sequence [X]$_3$ where X is a 12 mer peptide with the sequence: GSPAGSPTSTEE (SEQ ID NO: 35), GSEPATSGSE TP (SEQ ID NO: 36), GTSESA TPESGP (SEQ ID NO: 37), or GTSTEPSEGSAP (SEQ ID NO: 38). The insert was obtained by annealing the following pairs of phosphorylated synthetic oligonucleotide pairs:

```
                                                      (SEQ ID NO: 217)
AE1for: AGGTAGCCCDGCWGGYTCTCCDACYTCYACYGARGA (SEQ ID NO: 218)
AE1rev: ACCTTCYTCRGTRGARGTHGGAGARCCWGCHGGGCT (SEQ ID NO: 219)
AE2for: AGGTAGCGAACCKGCWACYTCYGGYTCTGARACYCC (SEQ ID NO: 220)
AE2rev: ACCTGGRGTYTCAGARCCRGARGTWGCMGGTTCGCT (SEQ ID NO: 221)
AE3for: AGGTACYTCTGAAAGCGCWACYCCKGARTCYGGYCC (SEQ ID NO: 222)
AE3rev: ACCTGGRCCRGAYTCMGGRGTWGCGCTTTCAGARGT (SEQ ID NO: 223)
AE4for: AGGTACYTCTACYGAACCKTCYGARGGYAGCGCWCC (SEQ ID NO: 224)
AE4rev: ACCTGGWGCGCTRCCYTCRGAMGGTTCGTAGARGT
```

We also annealed the phosphorylated oligonucleotide 3KpnIstopperFor: AGGTTCGTCTTCACTCGAGGGTAC (SEQ ID NO: 139) and the non-phosphorylated oligonucleotide pr_3KpnIstopperRev: CCTCGAGTGAAGACGA (SEQ ID NO: 140). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stiffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs for these segments are listed in Table 10.

TABLE 10

DNA and Amino Acid Sequences for 36-mer motifs

| File name | Amino acid sequence | SEQ ID NO: | Nucleotide sequence | SEQ ID NO: |
|---|---|---|---|---|
| LCW0402_002_GFP-N_A07.ab1 | GSPAGSPTSTEEGTSESATPESGPGTSTEPSEGSAP | 225 | GGTAGCCCGGCAGGCTCTCCGACCTCTACTGAGGAAGGTACTTCTGAAAGCGCAACCCCGGAGTCCGGCCCAGGTACCTCTACCGAACCGTCTGAGGGCAGCGCACCA | 226 |
| LCW0402_003_GFP-N_B07.ab1 | GTSTEPSEGSAPGTSTEPSEGSAPGTSTEPSEGSAP | 227 | GGTACTTCTACCGAACCGTCCGAAGGCAGCGCTCCAGGTACCTCTACTGAACCTTCCGAGGGCAGCGCTCCAGGTACCTCTACCGAACCTTCTGAAGGTAGCGCACCA | 228 |
| LCW0402_004_GFP-N_C07.ab1 | GTSTEPSEGSAPGTSESATPESGPGTSESATPESGP | 229 | GGTACCTCTACCGAACCGTCTGAAGGTAGCGCACCAGGTACCTCTGAAAGCGCAACTCCTGAGTCCGGTCCAGGTACTTCTGAAAGCGCAACCCCGGAGTCTGGCCCA | 230 |
| LCW0402_005_GFP-N_D07.ab1 | GTSTEPSEGSAPGTSESATPESGPGTSESATPESGP | 231 | GGTACTTCTACTGAACCGTCTGAAGGTAGCGCACCAGGTACTTCTGAAAGCGCAACCCCGGAATCCGGCCCAGGTACCTCTGAAAGCGCAACCCCGGAGTCCGGCCCA | 231 |
| LCW0402_006_GFP-N_E07.ab1 | GSEPATSGSETPGTSESATPESGPGSPAGSPTSTEE | 233 | GGTAGCGAACCGGCAACCTCCGGCTCTGAAACCCCAGGTACCTCTGAAAGCGCTACTCCTGAATCCGGCCCAGGTAGCCCGGCAGGTTCTCCGACTTCCACTGAGGAA | 234 |
| LCW0402_008_GFP-N_F07.ab1 | GTSESATPESGPGSEPATSGSETPGTSTEPSEGSAP | 235 | GGTACTTCTGAAAGCGCAACCCCTGAATCCGGTCCAGGTAGCGAACCGGCTACTTCTGGCTCTGAGACTCCAGGTACTTCTACCGAACCGTCCGAAGGTAGCGCACCA | 236 |
| LCW0402_009_GFP-N_G07.ab1 | GSPAGSPTSTEEGSPAGSPTSTEEGSEPATSGSETP | 237 | GGTAGCCCGGCTGGCTCTCCAACCTCCACTGAGGAAGGTAGCCCGGCTGGCTCTCCAACCTCCACTGAAGAAGGTAGCGAACCGGCTACCTCCGGCTCTGAAACTCCA | 238 |
| LCW0402_011_GFP-N_A08.ab1 | GSPAGSPTSTEEGTSESATPESGPGTSTEPSEGSAP | 239 | GGTAGCCCGGCTGGCTCTCCTACCTCTACTGAGGAAGGTACTTCTGAAAGCGCTACTCCTGAGTCTGGTCCAGGTACCTCTACTGAACCGTCCGAAGGTAGCGCTCCA | 240 |
| LCW0402_012_GFP-N_B08.ab1 | GSPAGSPTSTEEGSPTSTEEGTSTEPSEGSAP | 241 | GGTAGCCCTGCTGGCTCTCCGACTTCTACTGAGGAAGGTAGCCCGGCTGGTTCTCCGACTTCTACTGAGGAAGGTACTTCTACCGAACCTTCCGAAGGTAGCGCTCCA | 242 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_013_GFP-N_C08.ab1 | GTSESATPESGPGTSTEPSEGSAPGTSTEPSEGSAP | 243 | GGTACTTCTGAAAGCGCTACTCCGGAGTCCGGTCCAGGTACCTCTACCGAACCGTCCGAAGGCAGCGCTCCAGGTACTTCTACTGAACCTTCTGAGGGTAGCGCTCCA | 244 |
| LCW0402_014_GFP-N_D08.ab1 | GTSTEPSEGSAPGSPAGSPTSTEEGTSTEPSEGSAP | 245 | GGTACCTCTACCGAACCTTCCGAAGGTAGCGCTCCAGGTAGCCCGGCAGGTTCTCCTACTTCCACTGAGGAAGGTACTTCTACCGAACCTTCTGAGGGTAGCGCACCA | 246 |
| LCW0402_015_GFP-N_E08.ab1 | GSEPATSGSETPGSPAGSPTSTEEGTSESATPESGP | 247 | GGTAGCGAACCGGCTACTTCCGGCTCTGAGACTCCAGGTAGCCCTGCTGGCTCTCCGACCTCTACCGAAGAAGGTACCTCTGAAAGCGCTACCCCTGAGTCTGGCCCA | 248 |
| LCW0402_016_GFP-N_F08.ab1 | GTSTEPSEGSAPGTSESATPESGPGTSESATPESGP | 249 | GGTACTTCTACCGAACCTTCCGAGGGCAGCGCACCAGGTACTTCTGAAAGCGCTACCCCTGAGTCCGGCCCAGGTACTTCTGAAAGCGCTACTCCTGAATCCGGTCCA | 250 |
| LCW0402_020_GFP-N_G08.ab1 | GTSTEPSEGSAPGSEPATSGSETPGSPAGSPTSTEE | 251 | GGTACTTCTACTGAACCGTCTGAAGGCAGCGCACCAGGTAGCGAACCGGCTACTTCCGGTTCTGAAACCCCAGGTAGCCCCAGCAGGTTCTCCAACTTCTACTGAAGAA | 252 |
| LCW0402_023_GFP-N_A09.ab1 | GSPAGSPTSTEEGTSESATPESGPGSEPATSGSETP | 253 | GGTAGCCCTGCTGGCTCTCCAACCTCCACCGAAGAAGGTACCTCTGAAAGCGCAACCCTGAATCCGGCCCAGGTAGCGAACCGGCAACCTCCGGTTCTGAAACCCCA | 254 |
| LCW0402_024_GFP-N_B09.ab1 | GTSESATPESGPGSPAGSPTSTEEGSPAGSPTSTEE | 255 | GGTACTTCTGAAAGCGCTACTCCTGAGTCCGGCCCAGGTAGCCCGGCTGGCTCTCCGACTTCCACCGAGGAAGGTAGCCCGGCTGGCTCTCCAACTTCTACTGAAGAA | 256 |
| LCW0402_025_GFP-N_C09.ab1 | GTSTEPSEGSAPGTSESATPESGPGTSTEPSEGSAP | 257 | GGTACCTCTACTGAACCTTCTGAGGGCAGCGCTCCAGGTACTTCTGAAAGCGCTACCCCGGAGTCCGGTCCAGGTACTTCTACTGAACCGTCCGAAGGTAGCGCACCA | 258 |
| LCW0402_026_GFP-N_D09.ab1 | GSPAGSPTSTEEGTSTEPSEGSAPGSEPATSGSETP | 259 | GGTAGCCCCGGCAGGCTCTCCGACTTCCACCGAGGAAGGTACCTCTACTGAACCTTCTGAGGGTAGCGCTCCAGGTAGCGAACCGGCAACCTCTGGCTCTGAAACCCCA | 260 |
| LCW0402_027_GFP-N_E09.ab1 | GSPAGSPTSTEEGTSTEPSEGSAPGTSTEPSEGSAP | 261 | GGTAGCCCAGCAGGCTCTCCGACTTCCACTGAGGAAGGTACTTCTACTGAACCTTCCGAAGGCAGCGCACCAGGTACCTCTACTGAACCTTCTGAGGGCAGCGCTCCA | 262 |
| LCW0402_032_GFP-N_H09.ab1 | GSEPATSGSETPGTSESATPESGPGSPAGSPTSTEE | 263 | GGTAGCGAACCTGCTACCTCCGGTTCTGAAACCCCAGGTACCTCTGAAAGCGCAACTCCGGAGTCTGGTCCAGGTAGCCCTGCAGGTTCTCCTACCTCCACTGAGGAA | 264 |
| LCW0402_034_GFP-N_A10.ab1 | GTSESATPESGPGTSTEPSEGSAPGTSTEPSEGSAP | 265 | GGTACCTCTGAAAGCGCTACTCCGGAGTCTGGCCCAGGTACCTCTACTGAACCGTCTGAGGGTAGCGCTCCAGGTACTTCTACTGAACCGTCCGAAGGTAGCGCACCA | 266 |
| LCW0402_036_GFP-N_C10.ab1 | GSPAGSPTSTEEGTSTEPSEGSAPGTSTEPSEGSAP | 267 | GGTAGCCCGGCTGGTTCTCCGACTTCCACCGAGGAAGGTACCTCTACTGAACCTTCTGAGGGTAGCGCTCCAGGTACCTCTACTGAACCTTCCGAAGGCAGCGCTCCA | 268 |
| LCW0402_039_GFP-N_E10.ab1 | GTSTEPSEGSAPGTSTEPSEGSAPGTSTEPSEGSAP | 269 | GGTACTTCTACCGAACCGTCCGAGGGCAGCGCTCCAGGTACTTCTACTGAACCTTCTGAAGGCAGCGCTCCAGGTACTTCTACTGAACCTTCCGAAGGTAGCGCACCA | 270 |
| LCW0402_040_GFP-N_F10.ab1 | GSEPATSGSETPGTSESATPESGPGTSTEPSEGSAP | 271 | GGTAGCGAACCTGCAACCTCTGGCTCTGAAACCCCAGGTACCTCTGAAAGCGCTACTCCTGAATCTGGCCCAGGTACTTCTACTGAACCGTCCGAGGGCAGCGCACCA | 272 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_041_GFP-N_G10.ab1 | GTSTEPSEGSAPGSPA GSPTSTEEGTSTEPSE GSAP | 273 | GGTACTTCTACCGAACCGTCCGAGGGTA GCGCACCAGGTAGCCCAGCAGGTTCTCC TACCTCCACCGAGGAAGGTACTTCTACC GAACCGTCCGAGGGTAGCGCACCA | 274 |
| LCW0402_050_GFP-N_A11.ab1 | GSEPATSGSETPGTSE SATPESGPGSEPATSG SETP | 275 | GGTAGCGAACCGGCAACCTCCGGCTCTG AAACTCCAGGTACTTCTGAAAGCGCTAC TCCGGAATCCGGCCCAGGTAGCGAACCG GCTACTTCCGGCTCTGAAACCCCA | 276 |
| LCW0402_051_GFP-N_B11.ab1 | GSEPATSGSETPGTSE SATPESGPGSEPATSG SETP | 277 | GGTAGCGAACCGGCAACTTCCGGCTCTG AAACCCCAGGTACTTCTGAAAGCGCTAC TCCTGAGTCTGGCCCAGGTAGCGAACCT GCTACCTCTGGCTCTGAAACCCCA | 278 |
| LCW0402_059_GFP-N_E11.ab1 | GSEPATSGSETPGSEP ATSGSETPGTSTEPSE GSAP | 279 | GGTAGCGAACCGGCAACCTCTGGCTCTG AAACTCCAGGTAGCGAACCTGCAACCTC CGGCTCTGAAACCCCAGGTACTTCTACTG AACCTTCTGAGGGCAGCGCACCA | 280 |
| LCW0402_060_GFP-N_F11.ab1 | GTSESATPESGPGSEP ATSGSETPGSEPATSG SETP | 281 | GGTACTTCTGAAAGCGCTACCCCGGAAT CTGGCCCAGGTAGCGAACCGGCTACTTC TGGTTCTGAAACCCCAGGTAGCGAACCG GCTACCTCCGGTTCTGAAACTCCA | 282 |
| LCW0402_061_GFP-N_G11.ab1 | GTSTEPSEGSAPGTST EPSEGSAPGTSESATP ESGP | 283 | GGTACCTCTACTGAACCTTCCGAAGGCA GCGCTCCAGGTACCTCTACCGAACCGTC CGAGGGCAGCGCACCAGGTACTTCTGAA AGCGCAACCCCTGAATCCGGTCCA | 284 |
| LCW0402_065_GFP-N_A12.ab1 | GSEPATSGSETPGTSE SATPESGPGTSESATP ESGP | 285 | GGTAGCGAACCGGCAACCTCTGGCTCTG AAACCCCAGGTACCTCTGAAAGCGCTAC TCCGGAATCTGGTCCAGGTACTTCTGAA AGCGCTACTCCGGAATCCGGTCCA | 286 |
| LCW0402_066_GFP-N_B12.ab1 | GSEPATSGSETPGSEP ATSGSETPGTSTEPSE GSAP | 287 | GGTAGCGAACCTGCTACCTCCGGCTCTG AAACTCCAGGTAGCGAACCGGCTACTTC CGGTTCTGAAACTCCAGGTACCTCTACCG AACCTTCCGAAGGCAGCGCACCA | 288 |
| LCW0402_067_GFP-N_C12.ab1 | GSEPATSGSETPGTST EPSEGSAPGSEPATSG SETP | 289 | GGTAGCGAACCTGCTACTTCTGGTTCTGA AACTCCAGGTACTTCTACCGAACCGTCC GAGGGTAGCGCTCCAGGTAGCGAACCTG CTACTTCTGGTTCTGAAACTCCA | 290 |
| LCW0402_069_GFP-N_D12.ab1 | GTSTEPSEGSAPGTST EPSEGSAPGSEPATSG SETP | 291 | GGTACCTCTACCGAACCGTCCGAGGGTA GCGCACCAGGTACCTCTACTGAACCGTC TGAGGGTAGCGCTCCAGGTAGCGAACCG GCAACCTCCGGTTCTGAAACTCCA | 292 |
| LCW0402_073_GFP-N_F12.ab1 | GTSTEPSEGSAPGSEP ATSGSETPGSPAGSPT STEE | 293 | GGTACTTCTACTGAACCTTCCGAAGGTA GCGCTCCAGGTAGCGAACCTGCTACTTCT GGTTCTGAAACCCAGGTAGCCCGGCTG GCTCTCCGACCTCCACCGAGGAA | 294 |
| LCW0402_074_GFP-N_G12.ab1 | GSEPATSGSETPGSPA GSPTSTEEGTSESATP ESGP | 295 | GGTAGCGAACCGGCTACTTCCGGCTCTG AGACTCCAGGTAGCCCAGCTGGTTCTCC AACCTCTACTGAGGAAGGTACTTCTGAA AGCGCTACCCCTGAATCTGGTCCA | 296 |
| LCW0402_075_GFP-N_H12.ab1 | GTSESATPESGPGSEP ATSGSETPGTSESATP ESGP | 297 | GGTACCTCTGAAAGCGCAACTCCTGAGT CTGGCCCAGGTAGCGAACCTGCTACCTC CGGCTCTGAGACTCCAGGTACCTCTGAA AGCGCAACCCCGGAATCTGGTCCA | 298 |

Example 3

Construction of XTEN_AF36 Segments

A codon library encoding sequences of 36 amino acid length was constructed. The sequences were designated XTEN_AF36. Its segments have the amino acid sequence [X]3 where X is a 12 mer peptide with the sequence: GST-SESPSGTAP (SEQ ID NO: 39), GTSTPESGSASP (SEQ ID NO: 40), GTSPSGESSTAP (SEQ ID NO: 41), or GSTSS-TAESPGP (SEQ ID NO: 42). The insert was obtained by annealing the following pairs of phosphorylated synthetic oligonucleotide pairs:

```
                                          (SEQ ID NO: 299)
AF1for: AGGTTCTACYAGCGAATCYCCKTCTGGYACYGCWCC (SEQ ID NO: 300)
AF1rev: ACCTGGWGCRGTRCCAGAMGGRGATTCGCTRGTAGA (SEQ ID NO: 301)
AF2for: AGGTACYTCTACYCCKGAAAGCGGYTCYGCWTCTCC (SEQ ID NO: 302)
AF2rev: ACCTGGAGAWGCRGARCCGCTTTCMGGRGTAGARGT (SEQ ID NO: 303)
AF3for: AGGTACYTCYCCKAGCGGYGAATCTTCTACYGCWCC (SEQ ID NO: 304)
AF3rev: ACCTGGWGCRGTAGAAGATTCRCCGCTMGGRGARGT (SEQ ID NO: 305)
AF4for: AGGTTCYACYAGCTCTACYGCWGAATCTCCKGGYCC (SEQ ID NO: 306)
AF4rev: ACCTGGRCCMGGAGATTCWGCRGTAGAGCTRGTRGA
```

We also annealed the phosphorylated oligonucleotide 3KpnIstopperFor: AGGTTCGTCTTCACTCGAGGGTAC (SEQ ID NO: 139) and the non-phosphorylated oligonucleotide pr_3KpnIstopperRev: CCTCGAGTGAAGACGA (SEQ ID NO: 140). The annealed oligonucleotide pairs were ligated, which resulted in a mixture of products with varying length that represents the varying number of 12 mer repeats ligated to one BbsI/KpnI segment The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs for these segments are listed in Table 11.

TABLE 11

DNA and Amino Acid Sequences for 36-mer motifs

| File name | Amino acid sequence | SEQ ID NO: | Nucleotide sequence | SEQ ID NO: |
|---|---|---|---|---|
| LCW0403_004_GFP-N_A01.ab1 | GTSTPESGSASPGTSPSGESSTAPGTSPSGESSTAP | 307 | GGTACTTCTACTCCGGAAAGCGGTTCCGCATCTCCAGGTACTTCTCCTAGCGGTGAATCTTCTACTGCTCCAGGTACCTCTCCTAGCGGCGAATCTTCTACTGCTCCA | 308 |
| LCW0403_005_GFP-N_B01.ab1 | GTSPSGESSTAPGSTSSTAESPGPGTSPSGESSTAP | 309 | GGTACTTCTCCGAGCGGTGAATCTTCTACCGCACCAGGTTCTACTAGCTCTACCGCTGAATCTCCGGGCCCAGGTACTTCTCCGAGCGGTGAATCTTCTACTGCTCCA | 310 |
| LCW0403_006_GFP-N_C01.ab1 | GSTSSTAESPGPGTSPSGESSTAPGTSTPESGSASP | 311 | GGTTCCACCAGCTCTACTGCTGAATCTCCTGGTCCAGGTACCTCTCCTAGCGGTGAATCTTCTACTGCTCCAGGTACTTCTACTCCTGAAAGCGGCTCTGCTTCTCCA | 312 |
| LCW0403_007_GFP-N_D01.ab1 | GSTSSTAESPGPGSTSSTAESPGPGTSPSGESSTAP | 313 | GGTTCTACCAGCTCTACTGCAGAATCTCCTGGCCCAGGTTCCACCAGCTCTACCGCAGAATCTCCGGGTCCAGGTACTTCCCCTAGCGGTGAATCTTCTACCGCACCA | 314 |
| LCW0403_008_GFP-N_E01.ab1 | GSTSSTAESPGPGTSPSGESSTAPGTSTPESGSASP | 315 | GGTTCTACTAGCTCTACTGCTGAATCTCCTGGCCCAGGTACTTCTCCTAGCGGTGAATCTTCTACCGCTCCAGGTACCTCTACTCCGGAAAGCGGTTCTGCATCTCCA | 316 |
| LCW0403_010_GFP-N_F01.ab1 | GSTSSTAESPGPGTSTPESGSASPGSTSESPSGTAP | 317 | GGTTCTACCAGCTCTACCGCAGAATCTCCTGGTCCAGGTACCTCTACTCCGGAAAGCGGCTCTGCATCTCCAGGTTCTACTAGCGAATCTCCTTCTGGCACTGCACCA | 318 |
| LCW0403_011_GFP-N_G01.ab1 | GSTSSTAESPGPGTSTPESGSASPGTSTPESGSASP | 319 | GGTTCTACTAGCTCTACTGCAGAATCTCCTGGCCCAGGTACCTCTACTCCGGAAAGCGGCTCTGCATCTCTACCCCTGAAAGCGGTTCTGCATCTCCA | 320 |
| LCW0403_012_GFP-N_H01.ab1 | GSTSESPSGTAPGTSPSGESSTAPGSTSESPSGTAP | 321 | GGTTCTACCAGCGAATCTCCTTCTGGCACCGCTCCAGGTACCTCTCCTAGCGGCGAATCTTCTACCGCTCCAGGTTCTACTAGCGAATCTCCTTCTGGCACTGCACCA | 322 |
| LCW0403_013_GFP-N_A02.ab1 | GSTSSTAESPGPGTSSTAESPGPGTSPSGES | 323 | GGTTCCACCAGCTCTACTGCAGAATCTCCGGGCCCAGGTTCTACTAGCTCTACTGC | 324 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| | STAP | | AGAATCTCCGGGTCCAGGTACTTCTCCT AGCGGCGAATCTTCTACCGCTCCA | |
| LCW0403_014_GFP-N_B02.ab1 | GSTSSTAESPGPGTST PESGSASPGSTSESPS GTAP | 325 | GGTTCCACTAGCTCTACTGCAGAATCTC CTGGCCCAGGTACCTCTACCCCTGAAAG CGGCTCTGCATCTCCAGGTTCTACCAGC GAATCCCCGTCTGGCACCGCACCA | 326 |
| LCW0403_015_GFP-N_C02.ab1 | GSTSSTAESPGPGTS STAESPGPGTSPSGES STAP | 327 | GGTTCTACTAGCTCTACTGCTGAATCTCC GGGTCCAGGTTCTACCAGCTCTACTGCT GAATCTCCTGGTCCAGGTACCTCCCCGA GCGGTGAATCTTCTACTGCACCA | 328 |
| LCW0403_017_GFP-N_D02.ab1 | GSTSSTAESPGPGTS ESPSGTAPGSTSSTAE SPGP | 329 | GGTTCTACCAGCTCTACCGCTGAATCTC CTGGCCCAGGTTCTACCAGCGAATCCCC GTCTGGCACCGCACCAGGTTCTACTAGC TCTACCGCTGAATCTCCGGGTCCA | 330 |
| LCW0403_018_GFP-N_E02.ab1 | GSTSSTAESPGPGTS STAESPGPGTSSSTAE SPGP | 331 | GGTTCTACCAGCTCTACCGCAGAATCTC CTGGCCCAGGTTCCACTAGCTCTACCGC TGAATCTCCTGGTCCAGGTTCTACTAGC TCTACCGCTGAATCTCCTGGTCCA | 332 |
| LCW0403_019_GFP-N_F02.ab1 | GSTSESPSGTAPGSTS STAESPGPGTSSSTAE SPGP | 333 | GGTTCTACTAGCGAATCCCCTTCTGGTA CTGCTCCAGGTTCCACTAGCTCTACCGC TGAATCTCCTGGCCCAGGTTCCACTAGC TCTACTGCAGAATCTCCTGGTCCA | 334 |
| LCW0403_023_GFP-N_H02.ab1 | GSTSESPSGTAPGSTS ESPSGTAPGSTSESPS GTAP | 335 | GGTTCTACTAGCGAATCTCCTTCTGGTA CCGCTCCAGGTTCTACCAGCGAATCCCC GTCTGGTACTGCTCCAGGTTCTACCAGC GAATCCTTCTGGTACTGCACCA | 336 |
| LCW0403_024_GFP-N_A03.ab1 | GSTSSTAESPGPGTS STAESPGPGTSSSTAE SPGP | 337 | GGTTCCACCAGCTCTACTGCTGAATCTC CTGGCCCAGGTTCTACCAGCTCTACTGC TGAATCTCCGGGCCCAGGTTCCACCAGC TCTACCGCTGAATCTCCGGGTCCA | 338 |
| LCW0403_025_GFP-N_B03.ab1 | GSTSSTAESPGPGTS STAESPGPGTSPSGES STAP | 339 | GGTTCCACTAGCTCTACCGCAGAATCTC CTGGTCCAGGTTCTACTAGCTCTACTGC GAATCTCCGGGTCCAGGTACCTCCCCTA GCGGCGAATCTTCTACCGCTCCA | 340 |
| LCW0403_028_GFP-N_D03.ab1 | GSSPSASTGTGPGSST PSGATGSPGSSTPSGA TGSP | 341 | GGTTCTAGCCCTTCTGCTTCCACCGGTAC CGGCCCAGGTAGCTCTACTCCGTCTGGT GCAACTGGCTCTCCAGGTAGCTCTACTC CGTCTGGTGCAACCGGCTCCCCA | 342 |
| LCW0403_029_GFP-N_E03.ab1 | GTSPSGESSTAPGTST PESGSASPGSTSSTAE SPGP | 343 | GGTACTTCCCCTAGCGGTGAATCTTCTA CTGCTCCAGGTACCTCTACTCCGGAAAG CGGCTCCGCATCTCCAGGTTCTACTAGC TCTACTGCTGAATCTCCTGGTCCA | 344 |
| LCW0403_030_GFP-N_F03.ab1 | GSTSSTAESPGPGTS STAESPGPGTSTPESG SASP | 345 | GGTTCTACTAGCTCTACCGCTGAATCTC CGGGTCCAGGTTCTACCAGCTCTACTGC AGAATCTCCTGGCCCAGGTACTTCTACT CCGGAAAGCGGTTCCGCTTCTCCA | 346 |
| LCW0403_031_GFP-N_G03.ab1 | GTSPSGESSTAPGSTS STAESPGPGTSTPESG SASP | 347 | GGTACTTCTCCTAGCGGTGAATCTTCTA CCGCTCCAGGTTCTACCAGCTCTACTGC TGAATCTCCTGGCCCAGGTACTTCTACC CCGGAAAGCGGCTCCGCTTCTCCA | 348 |
| LCW0403_033_GFP-N_H03.ab1 | GSTSESPSGTAPGSTS STAESPGPGTSSSTAE SPGP | 349 | GGTTCTACTAGCGAATCCCCTTCTGGTA CTGCACCAGGTTCTACCAGCTCTACTGC TGAATCTCCGGGCCCAGGTTCCACCAGC TCTACCGCAGAATCTCCTGGTCCA | 350 |
| LCW0403_035_GFP-N_A04.ab1 | GSTSSTAESPGPGTS ESPSGTAPGSTSSTAE SPGP | 351 | GGTTCCACCAGCTCTACCGCTGAATCTC CGGGCCCAGGTTCTACCAGCGAATCCCC TTCTGGCACTGCACCAGGTTCTACTAGC TCTACCGCAGAATCTCCGGGCCCA | 352 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_036_GFP-N_B04.ab1 | GSTSSTAESPGPGTSPSGESSTAPGTSTPESGSASP | 353 | GGTTCTACCAGCTCTACTGCTGAATCTCCGGGTCCAGGTACTTCCCCGAGCGGTGAATCTTCTACTGCACCAGGTACTTCTACTCCGGAAAGCGGTTCCGCTTCTCCA | 354 |
| LCW0403_039_GFP-N_C04.ab1 | GSTSESPSGTAPGSTSESPSGTAPGTSPSGESSTAP | 355 | GGTTCTACCAGCGAATCTCCTTCTGGCACCGCTCCAGGTTCTACTAGCGAATCCCCGTCTGGTACCGCACCAGGTACTTCTCCTAGCGGCGAATCTTCTACCGCACCA | 356 |
| LCW0403_041_GFP-N_D04.ab1 | GSTSESPSGTAPGSTSESPSGTAPGTSTPESGSASP | 357 | GGTTCTACCAGCGAATCCCCTTCTGGTACTGCTCCAGGTTCTACCAGCGAATCCCCTTCTGGCACCGCACCAGGTACTTCTACCCCTGAAAGCGGCTCCGCTTCTCCA | 358 |
| LCW0403_044_GFP-N_E04.ab1 | GTSTPESGSASPGSTSSTAESPGPGSTSSTAESPGP | 359 | GGTACCTCTACTCCTGAAAGCGGTTCTGCATCTCCAGGTTCCACTAGCTCTACCGCAGAATCTCCGGGCCCAGGTTCTACTAGCTCTACTGCTGAATCTCCTGGCCCA | 360 |
| LCW0403_046_GFP-N_F04.ab1 | GSTSESPSGTAPGSTSESPSGTAPGTSPSGESSTAP | 361 | GGTTCTACCAGCGAATCCCCTTCTGGCACTGCACCAGGTTCTACTAGCGAATCCCCTTCTGGTACCGCACCAGGTACTTCTCCGAGCGGCGAATCTTCTACTGCTCCA | 362 |
| LCW0403_047_GFP-N_G04.ab1 | GSTSSTAESPGPGSTSSTAESPGPGSTSESPSGTAP | 363 | GGTTCTACTAGCTCTACCGCTGAATCTCCTGGCCCAGGTTCCACTAGCTCTACCGCAGAATCTCCGGGCCCAGGTTCTACTAGCGAATCCCCTTCTGGTACCGCTCCA | 364 |
| LCW0403_049_GFP-N_H04.ab1 | GSTSSTAESPGPGSTSSTAESPGPGTSTPESGSASP | 365 | GGTTCCACCAGCTCTACTGCAGAATCTCCTGGCCCAGGTTCTACTAGCTCTACCGCAGAATCTCCTGGTCCAGGTACCTCTACTCCTGAAAGCGGTTCCGCATCTCCA | 366 |
| LCW0403_051_GFP-N_A05.ab1 | GSTSSTAESPGPGSTSSTAESPGPGSTSESPSGTAP | 367 | GGTTCTACTAGCTCTACTGCTGAATCTCCGGGCCCAGGTTCTACTAGCTCTACCGCTGAATCTCCGGGTCCAGGTTCTACTAGCGAATCTCCTTCTGGTACCGCTCCA | 368 |
| LCW0403_053_GFP-N_B05.ab1 | GTSPSGESSTAPGSTSESPSGTAPGTSSTAESPGP | 369 | GGTACCTCCCCGAGCGGTGAATCTTCTACTGCACCAGGTTCTACTAGCGAATCCCCTTCTGGTACTGCTCCAGGTTCCACCAGCTCTACTGCAGAATCTCCGGGTCCA | 370 |
| LCW0403_054_GFP-N_C05.ab1 | GSTSESPSGTAPGTSPSGESSTAPGSTSSTAESPGP | 371 | GGTTCTACTAGCGAATCCCCGTCTGGTACTGCTCCAGGTACTTCCCCTAGCGGTGAATCTTCTACTGCTCCAGGTTCTACCAGCTCTACCGCAGAATCTCCGGGTCCA | 372 |
| LCW0403_057_GFP-N_D05.ab1 | GSTSSTAESPGPGSTSESPSGTAPGTSPSGESSTAP | 373 | GGTTCTACCAGCTCTACCGCTGAATCTCCTGGCCCAGGTTCTACTAGCGAATCTCCGTCTGGCACCGCACCAGGTACTTCCCCTAGCGGTGAATCTTCTACTGCACCA | 374 |
| LCW0403_058_GFP-N_E05.ab1 | GSTSESPSGTAPGSTSESPSGTAPGTSTPESGSASP | 375 | GGTTCTACTAGCGAATCTCCTTCTGGCACTGCACCAGGTTCTACCAGCGAATCTCCGTCTGGCACTGCACCAGGTACCTCTACCCCTGAAAGCGGTTCCGCTTCTCCA | 376 |
| LCW0403_060_GFP-N_F05.ab1 | GTSTPESGSASPGSTSESPSGTAPGSTSSTAESPGP | 377 | GGTACCTCTACTCCGGAAAGCGGTTCCGCATCTCCAGGTTCTACCAGCGAATCCCCGTCTGGCACCGCACCAGGTTCTACTAGCTCTACTGCTGAATCTCCGGGCCCA | 378 |
| LCW0403_063_GFP-N_G05.ab1 | GSTSSTAESPGPGTSPSGESSTAPGTSPSGESSTAP | 379 | GGTTCTACTAGCTCTACTGCAGAATCTCCGGGCCCAGGTACCTCTCCTAGCGGTGAATCTTCTACCGCTCCAGGTACTTCTCCGAGCGGTGAATCTTCTACCGCTCCA | 380 |
| LCW0403_064_GFP-N_H05.ab1 | GTSPSGESSTAPGTSPSGESSTAPGTSPSGESSTAP | 381 | GGTACCTCCCCTAGCGGCGAATCTTCTACTGCTCCAGGTACCTCTCCTAGCGGCGAATCTTCTACCGCTCCAGGTACCTCCCCTAGCGGTGAATCTTCTACCGCACCA | 382 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_065_GFP-N_A06.ab1 | GSTSSTAESPGPGTST PESGSASPGSTSESPS GTAP | 383 | GGTTCCACTAGCTCTACTGCTGAATCTC CTGGCCCAGGTACTTCTACTCCGGAAAG CGGTTCCGCTTCTCCAGGTTCTACTAGC GAATCTCCGTCTGGCACCGCACCA | 384 |
| LCW0403_066_GFP-N_B06.ab1 | GSTSESPSGTAPGTSP SGESSTAPGTSPSGES STAP | 385 | GGTTCTACTAGCGAATCTCCGTCTGGCA CTGCTCCAGGTACTTCTCCTAGCGGTGA ATCTTCTACCGCTCCAGGTACTTCCCCTA GCGGCGAATCTTCTACCGCTCCA | 386 |
| LCW0403_067_GFP-N_C06.ab1 | GSTSESPSGTAPGTST PESGSASPGSTSSTAE SPGP | 387 | GGTTCTACTAGCGAATCTCCTTCTGGTA CCGCTCCAGGTACTTCTACCCCTGAAAG CGGCTCCGCTTCTCCAGGTTCCACTAGC TCTACCGCTGAATCTCCGGGTCCA | 388 |
| LCW0403_068_GFP-N_D06.ab1 | GSTSSTAESPGPGSTS STAESPGPGSTSESPS GTAP | 389 | GGTTCCACTAGCTCTACTGCTGAATCTC CTGGCCCAGGTTCTACCAGCTCTACCGC TGAATCTCCTGGCCCAGGTTCTACCAGC GAATCTCCGTCTGGCACCGCACCA | 390 |
| LCW0403_069_GFP-N_E06.ab1 | GSTSESPSGTAPGTST PESGSASPGTSTPESG SASP | 391 | GGTTCTACTAGCGAATCCCCGTCTGGTA CCGCACCAGGTACTTCTACCCCGGAAAG CGGCTCTGCTTCTCCAGGTACTTCTACCC CGGAAAGCGGCTCCGCATCTCCA | 392 |
| LCW0403_070_GFP-N_F06.ab1 | GSTSESPSGTAPGTST PESGSASPGTSTPESG SASP | 393 | GGTTCTACTAGCGAATCCCCGTCTGGTA CTGCTCCAGGTACTTCTACTCCTGAAAG CGGTTCCGCTTCTCCAGGTACCTCTACTC CGGAAAGCGGTTCTGCATCTCCA | 394 |

Example 4

Construction of XTEN_AG36 Segments

A codon library encoding sequences of 36 amino acid length was constructed. The sequences were designated XTEN_AG36. Its segments have the amino acid sequence [X]$_3$ where X is a 12 mer peptide with the sequence: GTPGS-GTASSSP (SEQ ID NO: 43), GSSTPSGATGSP (SEQ ID NO: 44), GSSPSASTGTGP (SEQ ID NO: 45), or GASPGTSSTGSP (SEQ ID NO: 46). The insert was obtained by annealing the following pairs of phosphorylated synthetic oligonucleotide pairs:

```
                                        (SEQ ID NO: 395)
AG1for: AGGTACYCCKGGYAGCGGTACYGCWTCTTCYTCTCC (SEQ ID NO: 396)
AG1rev: ACCTGGAGARGAAGAWGCRGTACCGCTRCCMGGRGT (SEQ ID NO: 397)
AG2for: AGGTAGCTCTACYCCKTCTGGTGCWACYGGYTCYCC (SEQ ID NO: 398)
AG2rev: ACCTGGRGARCCRGTWGCACCAGAMGGRGTAGAGCT (SEQ ID NO: 399)
AG3for: AGGTTCTAGCCCKTCTGCWTCYACYGGTACYGGYCC (SEQ ID NO: 400)
AG3rev: ACCTGGRCCRGTACCRGTRGAWGCAGAMGGGCTAGA (SEQ ID NO: 401)
AG4for: AGGTGCWTCYCCKGGYACYAGCTCTACYGGTTCTCC (SEQ ID NO: 402)
AG4rev: ACCTGGAGAACCRGTAGAGCTRGTRCCMGGRGAWGC
```

We also annealed the phosphorylated oligonucleotide 3KpnIstopperFor: AGGTTCGTCTTCACTCGAGGGTAC (SEQ ID NO: 139) and the non-phosphorylated oligonucleotide pr_3KpnIstopperRev: CCTCGAGTGAAGACGA (SEQ ID NO: 140). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs for these segments are listed in Table 12.

TABLE 12

DNA and Amino Acid Sequences for 36-mer motifs

| File name | Amino acid sequence | SEQ ID NO: | Nucleotide sequence | SEQ ID NO: |
|---|---|---|---|---|
| LCW0404_001_GFP-N_A07.ab1 | GASPGTSSTGSPGTPG SGTASSSPGSSTPSGA TGSP | 403 | GGTGCATCCCCGGGCACTAGCTCTACCG GTTCTCCAGGTACTCCTGGTAGCGGTAC TGCTTCTTCTTCTCCAGGTAGCTCTACTC CTTCTGGTGCTACTGGTTCTCCA | 404 |
| LCW0404_003_GFP-N_B07.ab1 | GSSTPSGATGSPGSSP SASTGTGPGSSTPSGA TGSP | 405 | GGTAGCTCTACCCCTTCTGGTGCTACCG GCTCTCCAGGTTCTAGCCCGTCTGCTTC TACCGGTACCGGTCCAGGTAGCTCTACC CCTTCTGGTGCTACTGGTTCTCCA | 406 |
| LCW0404_006_GFP-N_C07.ab1 | GASPGTSSTGSPGSSP SASTGTGPGSSTPSGA TGSP | 407 | GGTGCATCTCCGGGTACTAGCTCTACCG GTTCTCCAGGTTCTAGCCCTTCTGCTTCC ACTGGTACCGGCCCAGGTAGCTCTACCC CGTCTGGTGCTACTGGTTCCCCA | 408 |
| LCW0404_007_GFP-N_D07.ab1 | GTPGSGTASSSPGSST PSGATGSPGASPGTSS TGSP | 409 | GGTACTCCGGGCAGCGGTACTGCTTCTT CCTCTCCAGGTAGCTCTACCCCTTCTGG TGCAACTGGTTCCCCAGGTGCATCCCCT GGTACTAGCTCTACCGGTTCTCCA | 410 |
| LCW0404_009_GFP-N_E07.ab1 | GTPGSGTASSSPGASP GTSSTGSPGSRPSAST GTGP | 411 | GGTACCCTGGCAGCGGTACTGCTTCTT CTTCTCCAGGTGCTTCCCCTGGTACCAG CTCTACCGGTTCTCCAGGTTCTAGACCT TCTGCATCCACCGGTACTGGTCCA | 412 |
| LCW0404_011_GFP-N_F07.ab1 | GASPGTSSTGSPGSST PSGATGSPGASPGTSS TGSP | 413 | GGTGCATCTCCTGGTACCAGCTCTACCG GTTCTCCAGGTAGCTCTACCCCTTCTGG TGCTACTGGCTCTCCAGGTGCTTCCCCG GGTACCAGCTCTACCGGTTCTCCA | 414 |
| LCW0404_012_GFP-N_G07.ab1 | GTPGSGTASSSPGSST PSGATGSPGSSTPSGA TGSP | 415 | GGTACCCCGGGCAGCGGTACCGCATCTT CCTCTCCAGGTAGCTCTACCCCGTCTGG TGCTACCGGTTCCCCAGGTAGCTCTACC CCGTCTGGTGCAACCGGCTCCCCA | 416 |
| LCW0404_014_GFP-N_H07.ab1 | GASPGTSSTGSPGASP GTSSTGSPGASPGTSS TGSP | 417 | GGTGCATCTCCGGGCACTAGCTCTACTG GTTCTCCAGGTGCATCCCCTGGCACTAG CTCTACTGGTTCTCCAGGTGCTTCTCCTG GTACCAGCTCTACTGGTTCTCCA | 418 |
| LCW0404_015_GFP-N_A08.ab1 | GSSTPSGATGSPGSSP SASTGTGPGASPGTSS TGSP | 419 | GGTAGCTCTACTCCGTCTGGTGCAACCG GCTCCCCAGGTTCTAGCCCGTCTGCTTC CACTGGTACTGGCCCAGGTGCTTCCCCG GGCACCAGCTCTACTGGTTCTCCA | 420 |
| LCW0404_016_GFP-N_B08.ab1 | GSSTPSGATGSPGSST PSGATGSPGTPGSGT ASSSP | 421 | GGTAGCTCTACTCCTTCTGGTGCTACCG GTTCCCCAGGTAGCTCTACTCCTTCTGG TGCTACTGGTTCCCCAGGTACTCCGGGC AGCGGTACTGCTTCTTCCTCTCCA | 422 |
| LCW0404_017_GFP-N_C08.ab1 | GSSTPSGATGSPGSST PSGATGSPGASPGTSS TGSP | 423 | GGTAGCTCTACTCCGTCTGGTGCAACCG GTTCCCCAGGTAGCTCTACTCCTTCTGG TGCTACTGGCTCCCCAGGTGCATCCCCT GGCACCAGCTCTACCGGTTCTCCA | 424 |
| LCW0404_018_GFP-N_D08.ab1 | GTPGSGTASSSPGSSP SASTGTGPGSSTPSGA TGSP | 425 | GGTACTCCTGGTAGCGGTACCGCATCTT CCTCTCCAGGTTCTAGCCCTTCTGCATCT ACCGGTACCGGTCCAGGTAGCTCTACTC CTTCTGGTGCTACTGGCTCTCCA | 426 |
| LCW0404_023_GFP-N_F08.ab1 | GASPGTSSTGSPGSSP SASTGTGPGTPGSGT ASSSP | 427 | GGTGCTTCCCCGGGCACTAGCTCTACCG GTTCTCCAGGTTCTAGCCCTTCTGCATCT ACTGGTACTGGCCCAGGTACTCCGGGCA GCGGTACTGCTTCTTCCTCTCCA | 428 |
| LCW0404_025_GFP-N_G08.ab1 | GSSTPSGATGSPGSST PSGATGSPGASPGTSS TGSP | 429 | GGTAGCTCTACTCCGTCTGGTGCTACCG GCTCTCCAGGTAGCTCTACCCCTTCTGG TGCAACCGGCTCCCCAGGTGCTTCTCCG GGTACCAGCTCTACTGGTTCTCCA | 430 |
| LCW0404_029_GFP-N_A09.ab1 | GTPGSGTASSSPGSST PSGATGSPGSSPSAST GTGP | 431 | GGTACCCTGGCAGCGGTACCGCTTCTT CCTCTCCAGGTAGCTCTACCCCGTCTGG TGCTACTGGCTCTCCAGGTTCTAGCCCG TCTGCATCTACCGGTACCGGCCCA | 432 |

TABLE 12-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_030_GFP-N_B09.ab1 | GSSTPSGATGSPGTPG SGTASSSPGTPGSGTA SSSP | 433 | GGTAGCTCTACTCCTTCTGGTGCAACCG GCTCCCCAGGTACCCCGGGCAGCGGTA CCGCATCTTCCTCTCCAGGTACTCCGGG TAGCGGTACTGCTTCTTCTTCTCCA | 434 |
| LCW0404_031_GFP-N_C09.ab1 | GTPGSGTASSSPGSST PSGATGSPGASPGTSS TGSP | 435 | GGTACCCCGGGTAGCGGTACTGCTTCTT CCTCTCCAGGTAGCTCTACCCCTTCTGG TGCAACCGGCTCTCCAGGTGCTTCTCCG GGCACCAGCTCTACCGGTTCTCCA | 436 |
| LCW0404_034_GFP-N_D09.ab1 | GSSTPSGATGSPGSST PSGATGSPGASPGTSS TGSP | 437 | GGTAGCTCTACCCCGTCTGGTGCTACCG GCTCTCCAGGTAGCTCTACCCCGTCTGG TGCAACCGGCTCCCCAGGTGCATCCCCG GGTACTAGCTCTACCGGTTCTCCA | 438 |
| LCW0404_035_GFP-N_E09.ab1 | GASPGTSSTGSPGTPG SGTASSSPGSSTPSGA TGSP | 439 | GGTGCTTCTCCGGGCACCAGCTCTACTG GTTCTCCAGGTACCCCGGGCAGCGGTAC CGCATCTTCTTCTCCAGGTAGCTCTACT CCTTCTGGTGCAACTGGTTCTCCA | 440 |
| LCW0404_036_GFP-N_F09.ab1 | GSSPSASTGTGPGSST PSGATGSPGTPGSGT ASSSP | 441 | GGTTCTAGCCCGTCTGCTTCCACCGGTA CTGGCCCAGGTAGCTCTACCCCGTCTGG TGCAACTGGTTCCCCAGGTACCCCTGGT AGCGGTACCGCTTCTTCTTCTCCA | 442 |
| LCW0404_037_GFP-N_G09.ab1 | GASPGTSSTGSPGSSP SASTGTGPGSSTPSGA TGSP | 443 | GGTGCTTCTCCGGGCACCAGCTCTACTG GTTCTCCAGGTTCTAGCCCTTCTGCATC CACCGGTACCGGTCCAGGTAGCTCTACC CCTTCTGGTGCAACCGGCTCTCCA | 444 |
| LCW0404_040_GFP-N_H09.ab1 | GASPGTSSTGSPGSST PSGATGSPGSSTPSGA TGSP | 445 | GGTGCATCCCCGGGCACCAGCTCTACCG GTTCTCCAGGTAGCTCTACCCCGTCTGG TGCTACCGGCTCTCCAGGTAGCTCTACC CCGTCTGGTGCTACTGGCTCTCCA | 446 |
| LCW0404_041_GFP-N_A10.ab1 | GTPGSGTASSSPGSST PSGATGSPGTPGSGT ASSSP | 447 | GGTACCCCTGGTAGCGGTACTGCTTCTT CCTCTCCAGGTAGCTCTACTCCGTCTGG TGCTACCGGTTCTCCAGGTACCCCGGGT AGCGGTACCGCATCTTCTTCTCCA | 448 |
| LCW0404_043_GFP-N_C10.ab1 | GSSPSASTGTGPGSST PSGATGSPGSSTPSGA TGSP | 449 | GGTTCTAGCCCTTCTGCTTCCACCGGTA CTGGCCCAGGTAGCTCTACCCCTTCTGG TGCTACCGGCTCCCCAGGTAGCTCTACT CCTTCTGGTGCAACTGGCTCTCCA | 450 |
| LCW0404_045_GFP-N_D10.ab1 | GASPGTSSTGSPGSSP SASTGTGPGSSPSAST GTGP | 451 | GGTGCTTCTCCTGGCACCAGCTCTACTG GTTCTCCAGGTTCTAGCCCTTCTGCTTCT ACCGGTACTGGTCCAGGTTCTAGCCCTT CTGCATCCACTGGTACTGGTCCA | 452 |
| LCW0404_047_GFP-N_F10.ab1 | GTPGSGTASSSPGASP GTSSTGSPGASPGTSS TGSP | 453 | GGTACTCCTGGCAGCGGTACCGCTTCTT CTTCTCCAGGTGCTTCTCCTGGTACTAG CTCTACTGGTTCTCCAGGTGCTTCTCCG GGCACTAGCTCTACTGGTTCTCCA | 454 |
| LCW0404_048_GFP-N_G10.ab1 | GSSTPSGATGSPGASP GTSSTGSPGSSTPSGA TGSP | 455 | GGTAGCTCTACCCCGTCTGGTGCTACCG GTTCCCCAGGTGCTTCTCCTGGTACTAG CTCTACCGGTTCTCCAGGTAGCTCTACC CCGTCTGGTGCTACTGGCTCTCCA | 456 |
| LCW0404_049_GFP-N_H10.ab1 | GSSTPSGATGSPGTPG SGTASSSPGSSTPSGA TGSP | 457 | GGTAGCTCTACCCCGTCTGGTGCTACTG GTTCTCCAGGTACTCCGGGCAGCGGTAC TGCTTCTTCCTCTCCAGGTAGCTCTACCC CTTCTGGTGCTACTGGCTCTCCA | 458 |
| LCW0404_050_GFP-N_A11.ab1 | GASPGTSSTGSPGSSP SASTGTGPGSSTPSGA TGSP | 459 | GGTGCATCTCCTGGTACCAGCTCTACTG GTTCTCCAGGTTCTAGCCCTTCTGCTTCT ACCGGTACCGGTCCAGGTAGCTCTACTC CTTCTGGTGCTACCGGTTCTCCA | 460 |
| LCW0404_051_GFP-N_B11.ab1 | GSSTPSGATGSPGSST PSGATGSPGSSTPSGA | 461 | GGTAGCTCTACCCCGTCTGGTGCTACTG GCTCTCCAGGTAGCTCTACTCCTTCTGG | 462 |

TABLE 12-continued

DNA and Amino Acid Sequences for 36-mer motifs

| File name | Amino acid sequence | SEQ ID NO: | Nucleotide sequence | SEQ ID NO: |
| --- | --- | --- | --- | --- |
| | TGSP | | TGCTACTGGTTCCCCAGGTAGCTCTACC CCGTCTGGTGCAACTGGCTCTCCA | |
| LCW0404_052_GFP-N_C11.ab1 | GASPGTSSTGSPGTPG SGTASSSPGASPGTSS TGSP | 463 | GGTGCATCCCCGGGTACCAGCTCTACCG GTTCTCCAGGTACTCCTGGCAGCGGTAC TGCATCTTCCTCTCCAGGTGCTTCTCCG GGCACCAGCTCTACTGGTTCTCCA | 464 |
| LCW0404_053_GFP-N_D11.ab1 | GSSTPSGATGSPGSSP SASTGTGPGASPGTSS TGSP | 465 | GGTAGCTCTACTCCTTCTGGTGCAACTG GTTCTCCAGGTTCTAGCCCGTCTGCATC CACTGGTACCGGTCCAGGTGCTTCCCCT GGCACCAGCTCTACCGGTTCTCCA | 466 |
| LCW0404_057_GFP-N_E11.ab1 | GASPGTSSTGSPGSST PSGATGSPGSSPSAST GTGP | 467 | GGTGCATCTCCTGGTACTAGCTCTACTG GTTCTCCAGGTAGCTCTACTCCGTCTGG TGCAACCGGCTCTCCAGGTTCTAGCCCT TCTGCATCTACCGGTACTGGTCCA | 468 |
| LCW0404_060_GFP-N_F11.ab1 | GTPGSGTASSSPGSST PSGATGSPGASPGTSS TGSP | 469 | GGTACTCCTGGCAGCGGTACCGCATCTT CCTCTCCAGGTAGCTCTACTCCGTCTGG TGCAACTGGTTCCCCAGGTGCTTCTCCG GGTACCAGCTCTACCGGTTCTCCA | 470 |
| LCW0404_062_GFP-N_G11.ab1 | GSSTPSGATGSPGTPG SGTASSSPGSSTPSGA TGSP | 471 | GGTAGCTCTACCCCGTCTGGTGCAACCG GCTCCCCAGGTACTCCTGGTAGCGGTAC CGCTTCTTCTTCTCCAGGTAGCTCTACTC CGTCTGGTGCTACCGGCTCCCCA | 472 |
| LCW0404_066_GFP-N_H11.ab1 | GSSPSASTGTGPGSSP SASTGTGPGASPGTSS TGSP | 473 | GGTTCTAGCCCTTCTGCATCCACCGGTA CCGGCCCAGGTTCTAGCCCGTCTGCTTC TACCGGTACTGGTCCAGGTGCTTCTCCG GGTACTAGCTCTACTGGTTCTCCA | 474 |
| LCW0404_067_GFP-N_A12.ab1 | GTPGSGTASSSPGSST PSGATGSPGSNPSAST GTGP | 475 | GGTACCCCGGGTAGCGGTACCGCTTCTT CTTCTCCAGGTAGCTCTACTCCGTCTGG TGCTACCGGCTCTCCAGGTTCTAACCCT TCTGCATCCACCGGTACCGGCCCA | 476 |
| LCW0404_068_GFP-N_B12.ab1 | GSSPSASTGTGPGSST PSGATGSPGASPGTSS TGSP | 477 | GGTTCTAGCCCTTCTGCATCTACTGGTA CTGGCCCAGGTAGCTCTACTCCTTCTGG TGCTACCGGCTCTCCAGGTGCTTCTCCG GGTACTAGCTCTACCGGTTCTCCA | 478 |
| LCW0404_069_GFP-N_C12.ab1 | GSSTPSGATGSPGASP GTSSTGSPGTPGSGTA SSSP | 479 | GGTAGCTCTACCCCTTCTGGTGCAACCG GCTCTCCAGGTGCATCCCCGGGTACCAG CTCTACCGGTTCTCCAGGTACTCCGGGT AGCGGTACCGCTTCTTCCTCTCCA | 480 |
| LCW0404_070_GFP-N_D12.ab1 | GSSTPSGATGSPGSST PSGATGSPGSSTPSGA TGSP | 481 | GGTAGCTCTACTCCGTCTGGTGCAACCG GTTCCCCAGGTAGCTCTACCCCTTCTGG TGCAACCGGCTCCCCAGGTAGCTCTACC CCTTCTGGTGCAACTGGCTCTCCA | 482 |
| LCW0404_073_GFP-N_E12.ab1 | GASPGTSSTGSPGTPG SGTASSSPGSSTPSGA TGSP | 483 | GGTGCTTCTCCTGGCACTAGCTCTACCG GTTCTCCAGGTACCCCTGGTAGCGGTAC CGCATCTTCCTCTCCAGGTAGCTCTACT CCTTCTGGTGCTACTGGTTCCCCA | 484 |
| LCW0404_075_GFP-N_F12.ab1 | GSSTPSGATGSPGSSP SASTGTGPGSSPSAST GTGP | 485 | GGTAGCTCTACCCCGTCTGGTGCTACTG GCTCCCCAGGTTCTAGCCCTTCTGCATC CACCGGTACCGGTCCAGGTTCTAGCCCG TCTGCATCTACTGGTACTGGTCCA | 486 |
| LCW0404_080_GFP-N_G12.ab1 | GASPGTSSTGSPGSSP SASTGTGPGSSPSAST GTGP | 487 | GGTGCTTCCCCGGGCACCAGCTCTACTG GTTCTCCAGGTTCTAGCCCGTCTGCTTCT ACTGGTACTGGTCCAGGTTCTAGCCCTT CTGCTTCCACTGGTACTGGTCCA | 488 |
| LCW0404_081_GFP-N_H12.ab1 | GASPGTSSTGSPGSSP SASTGTGPGTPGSGT ASSSP | 489 | GGTGCTTCCCCGGGTACCAGCTCTACCG GTTCTCCAGGTTCTAGCCCTTCTGCTTCT ACCGGTACCGGTCCAGGTACCCCTGGCA GCGGTACCGCATCTTCCTCTCCA | 490 |

Example 5

Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of *E. coli* harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6

Construction of XTEN_AM144

A collection of XTEN_AM144 segments was constructed starting from 37 different segments of XTEN_AE36, 44 segments of XTEN_AF36, and 44 segments of XTEN_AG36.

Cultures of *E. coli* harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm. 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs for these segments are listed in Table 13.

TABLE 13

DNA and amino acid sequences for AM144 segments

| Clone | Sequence Trimmed | SEQ ID NO: | Protein Sequence | SEQ ID NO: |
|---|---|---|---|---|
| LCW462_r1 | GGTACCCCGGGCAGCGGTACCGCATCTT CCTCTCCAGGTAGCTCTACCCCGTCTGGT GCTACCGGTTCCCCAGGTAGCTCTACCCC GTCTGGTGCAACCGGCTCCCCAGGTAGC CCGGCTGGCTCTCCTACCTCTACTGAGGA AGGTACTTCTGAAAGCGCTACTCCTGAG TCTGGTCCAGGTACCTCTACTGAACCGTC CGAAGGTAGCGCTCCAGGTTCTAGCCCT TCTGCATCCACCGGTACCGGCCCAGGTTC TAGCCCGTCTGCTTCTACCGGTACTGGTC CAGGTGCTTCTCCGGGTACTAGCTCTACT GGTTCTCCAGGTACCTCTACCGAACCGTC CGAGGGTAGCGCACCAGGTACCTCTACT GAACCGTCTGAGGGTAGCGCTCCAGGTA GCGAACCGGCAACCTCCGGTTCTGAAAC TCCA | 491 | GTPGSGTASSSPGSSTPS GATGSPGSSTPSGATGSP GSPAGSPTSTEEGTSESA TPESGPGTSTEPSEGSAP GSSPSASTGTGPGSSPSA STGTGPGASPGTSSTGSP GTSTEPSEGSAPGTSTEP SEGSAPGSEPATSGSETP | 492 |
| LCW462_r5 | GGTTCTACCAGCGAATCCCCTTCTGGCAC TGCACCAGGTTCTACTAGCGAATCCCCTT CTGGTACCGCACCAGGTACTTCTCCGAG CGGCGAATCTTCTACTGCTCCAGGTACCT CTACTGAACCTTCCGAAGGCAGCGCTCC AGGTACCTCTACCGAACCGTCCGAGGGC AGCGCACCAGGTACTTCTGAAAGCGCAA CCCCTGAATCCGGTCCAGGTGCATCTCCT GGTACCAGCTCTACCGGTTCTCCAGGTA GCTCTACTCCTTCTGGTGCTACTGGCTCT | 493 | GSTSESPSGTAPGSTSESP SGTAPGTSPSGESSTAPG TSTEPSEGSAPGTSTEPSE GSAPGTSESATPESGPGA SPGTSSTGSPGSSTPSGA TGSPGASPGTSSTGSPGS TSESPSGTAPGSTSESPSG TAPGTSTPESGSASP | 494 |

TABLE 13-continued

DNA and amino acid sequences for AM144 segments

| Clone | Sequence Trimmed | SEQ ID NO: | Protein Sequence | SEQ ID NO: |
|---|---|---|---|---|
| | CCAGGTGCTTCCCCGGGTACCAGCTCTAC CGGTTCTCCAGGTTCTACTAGCGAATCTC CTTCTGGCACTGCACCAGGTTCTACCAGC GAATCTCCGTCTGGCACTGCACCAGGTA CCTCTACCCCTGAAAGCGGTTCCGCTTCT CCA | | | |
| LCW462_r9 | GGTACTTCTACCGAACCTTCCGAGGGCA GCGCACCAGGTACTTCTGAAAGCGCTAC CCCTGAGTCCGGCCCAGGTACTTCTGAA AGCGCTACTCCTGAATCCGGTCCAGGTA CCTCTACTGAACCTTCTGAGGGCAGCGCT CCAGGTACTTCTGAAAGCGCTACCCCGG AGTCCGGTCCAGGTACTTCTACTGAACC GTCCGAAGGTAGCGCACCAGGTACTTCT ACTGAACCTTCCGAAGGTAGCGCTCCAG GTAGCGAACCTGCTACTTCTGGTTCTGAA ACCCCAGGTAGCCCGGCTGGCTCTCCGA CCTCCACCGAGGAAGGTGCTTCTCCTGG CACCAGCTCTACTGGTTCTCCAGGTTCTA GCCCTTCTGCTTCTACCGGTACTGGTCCA GGTTCTAGCCCTTCTGCATCCACTGGTAC TGGTCCA | 495 | GTSTEPSEGSAPGTSESA TPESGPGTSESATPESGP GTSTEPSEGSAPGTSESA TPESGPGTSTEPSEGSAP GTSTEPSEGSAPGSEPAT SGSETPGSPAGSPTSTEE GASPGTSSTGSPGSSPSA STGTGPGSSPSASTGTGP | 496 |
| LCW462_r10 | GGTAGCGAACCGGCAACCTCTGGCTCTG AAACCCCAGGTACCTCTGAAAGCGCTAC TCCGGAATCTGGTCCAGGTACTTCTGAA AGCGCTACTCCGGAATCCGGTCCAGGTT CTACCAGCGAATCTCCTTCTGGCACCGCT CCAGGTTCTACTAGCGAATCCCGTCTGG TACCGCACCAGGTACTTCTCCTAGCGGC GAATCTTCTACCGCACCAGGTGCATCTCC GGGTACTAGCTCTACCGGTTCTCCAGGTT CTAGCCCTTCTGCTTCCACTGGTACCGGC CCAGGTAGCTCTACCCCGTCTGGTGCTAC TGGTTCCCCAGGTAGCTCTACTCCGTCTG GTGCAACCGGTTCCCCAGGTAGCTCTACT CCTTCTGGTGCTACTGGCTCCCAGGTGC ATCCCCTGGCACCAGCTCTACCGGTTCTC CA | 497 | GSEPATSGSETPGTSESA TPESGPGTSESATPESGP GSTSESPSGTAPGSTSESP SGTAPGTSPSGESSTAPG ASPGTSSTGSPGSSPSAS TGTGPGSSTPSGATGSPG SSTPSGATGSPGSSTPSG ATGSPGASPGTSSTGSP | 498 |
| LCW462_r15 | GGTGCTTCTCCGGGCACCAGCTCTACTGG TTCTCCAGGTTCTAGCCCTTCTGCATCCA CCGGTACCGGTCCAGGTAGCTCTACCCCT TCTGGTGCAACCGGCTCTCCAGGTACTTC TGAAAGCGCTACCCCGGAATCTGGCCCA GGTAGCGAACCGGCTACTTCTGGTTCTG AAACCCCAGGTAGCGAACCGGCTACCTC CGGTTCTGAAACTCCAGGTACTTCTGAA AGCGCTACTCCGGAGTCCGGTCCAGGTA CCTCTACCGAACCGTCCGAAGGCAGCGC TCCAGGTACTTCTACTGAACCTTCTGAGG GTAGCGCTCCAGGTACCTCTACCGAACC GTCCGAGGGTAGCGCACCAGGTACCTCT ACTGAACCGTCTGAGGGTAGCGCTCCAG GTAGCGAACCGGCAACCTCCGGTTCTGA AACTCCA | 499 | GASPGTSSTGSPGSSPSA STGTGPGSSTPSGATGSP GTSESATPESGPGSEPAT SGSETPGSEPATSGSETP GTSESATPESGPGTSTEP SEGSAPGTSTEPSEGSAP GTSTEPSEGSAPGTSTEP SEGSAPGSEPATSGSETP | 500 |
| LCW462_r16 | GGTACCTCTACCGAACCTTCCGAAGGTA GCGCTCCAGGTAGCCCGGCAGGTTCTCC TACTTCCACTGAGGAAGGTACTTCTACCG AACCTTCTGAGGGTAGCGCACCAGGTAC CTCTGAAAGCGCAACTCCTGAGTCTGGC CCAGGTAGCGAACCTGCTACCTCCGGCT CTGAGACTCCAGGTACCTCTGAAAGCGC AACCCCGGAATCTGGTCCAGGTAGCCCG GCTGGCTCTCCTACCTCTACTGAGGAAG GTACTTCTGAAAGCGCTACTCCTGAGTCT GGTCCAGGTACCTCTACTGAACCGTCCG AAGGTAGCGCTCCAGGTAGCGAACCTGC TACTTCTGGTTCTGAAACTCCAGGTACTT CTACCGAACCGTCCGAGGGTAGCGCTCC AGGTAGCGAACCTGCTACTTCTGGTTCTG AAACTCCA | 501 | GTSTEPSEGSAPGSPAGS PTSTEEGTSTEPSEGSAP GTSESATPESGPGSEPAT SGSETPGTSESATPESGP GSPAGSPTSTEEGTSESA TPESGPGTSTEPSEGSAP GSEPATSGSETPGTSTEP SEGSAPGSEPATSGSETP | 502 |

TABLE 13-continued

DNA and amino acid sequences for AM144 segments

| Clone | Sequence Trimmed | SEQ ID NO: | Protein Sequence | SEQ ID NO: |
|---|---|---|---|---|
| LCW462_r20 | GGTACTTCTACCGAACCGTCCGAAGGCA GCGCTCCAGGTACCTCTACTGAACCTTCC GAGGGCAGCGCTCCAGGTACCTCTACCG AACCTTCTGAAGGTAGCGCACCAGGTAC TTCTACCGAACCGTCCGAAGGCAGCGCT CCAGGTACCTCTACTGAACCTTCCGAGG GCAGCGCTCCAGGTACCTCTACCGAACC TTCTGAAGGTAGCGCACCAGGTACTTCT ACCGAACCTTCCGAGGGCAGCGCACCAG GTACTTCTGAAAGCGCTACCCCTGAGTCC GGCCCAGGTACTTCTGAAAGCGCTACTC CTGAATCCGGTCCAGGTACTTCTACTGAA CCTTCCGAAGGTAGCGCTCCAGGTAGCG AACCTGCTACTTCTGGTTCTGAAACCCCA GGTAGCCCGGCTGGCTCTCCGACCTCCA CCGAGGAA | 503 | GTSTEPSEGSAPGTSTEP SEGSAPGTSTEPSEGSAP GTSTEPSEGSAPGTSTEP SEGSAPGTSTEPSEGSAP GTSTEPSEGSAPGTSESA TPESGPGTSESATPESGP GTSTEPSEGSAPGSEPAT SGSETPGSPAGSPTSTEE | 504 |
| LCW462_r23 | GGTACTTCTACCGAACCGTCCGAGGGCA GCGCTCCAGGTACTTCTACTGAACCTTCT GAAGGCAGCGCTCCAGGTACTTCTACTG AACCTTCCGAAGGTAGCGCACCAGGTTC TACCAGCGAATCCCCTTCTGGTACTGCTC CAGGTTCTACCAGCGAATCCCCTTCTGGC ACCGCACCAGGTACTTCTACCCCTGAAA GCGGCTCCGCTTCTCCAGGTAGCGAACC TGCAACCTCTGGCTCTGAAACCCCAGGT ACCTCTGAAAGCGCTACTCCTGAATCTG GCCCAGGTACTTCTACTGAACCGTCCGA GGGCAGCGCACCAGGTACTTCTACTGAA CCGTCTGAAGGTAGCGCACCAGGTACTT CTGAAAGCGCAACCCCGGAATCCGGCCC AGGTACCTCTGAAAGCGCAACCCCGGAG TCCGGCCCA | 505 | GTSTEPSEGSAPGTSTEP SEGSAPGTSTEPSEGSAP GSTSESPSGTAPGSTSESP SGTAPGTSTPESGSASPG SEPATSGSETPGTSESAT PESGPGTSTEPSEGSAPG TSTEPSEGSAPGTSESAT PESGPGTSESATPESGP | 506 |
| LCW462_r24 | GGTAGCTCTACCCCTTCTGGTGCTACCGG CTCTCCAGGTTCTAGCCCGTCTGCTTCTA CCGGTACCGGTCCAGGTAGCTCTACCCCT TCTGGTGCTACTGGTTCTCCAGGTAGCCC TGCTGGCTCTCCGACTTCTACTGAGGAAG GTAGCCCGGCTGGTTCTCCGACTTCTACT GAGGAAGGTACTTCTACCGAACCTTCCG AAGGTAGCGCTCCAGGTGCTTCCCCGGG CACTAGCTCTACCGGTTCTCCAGGTTCTA GCCCTTCTGCATCTACTGGTACTGGCCCA GGTACTCCGGGCAGCGGTACTGCTTCTTC CTCTCCAGGTTCTACTAGCTCTACTGCTG AATCCTCTGGCCCAGGTACTTCTCCTAGC GGTGAATCTTCTACCGCTCCAGGTACCTC TACTCCGGAAAGCGGTTCTGCATCTCCA | 507 | GSSTPSGATGSPGSSPSA STGTGPGSSTPSGATGSP GSPAGSPTSTEEGSPAGS PTSTEEGTSTEPSEGSAP GASPGTSSTGSPGSSPSA STGTGPGTPGSGTASSSP GSTSSTAESPGPGTSPSG ESSTAPGTSTPESGSASP | 508 |
| LCW462_r27 | GGTACCTCTACTGAACCTTCTGAGGGCA GCGCTCCAGGTACTTCTGAAAGCGCTAC CCCGGAGTCCGGTCCAGGTACTTCTACTG AACCGTCCGAAGGTAGCGCACCAGGTAC TTCTACTGAACCGTCTGAAGGTAGCGCA CCAGGTACTTCTGAAAGCGCAACCCCGG AATCCGGCCCAGGTACCTCTGAAAGCGC AACCCCGGAGTCCGGCCCAGGTACTCCT GGCAGCGGTACCGCTTCTTCTTCTCCAGG TGCTTCTCCTGGTACTAGCTCTACTGGTT CTCCAGGTGCTTCTCCGGGCACTAGCTCT ACTGGTTCTCCAGGTAGCCCTGCTGGCTC TCCGACTTCTACTGAGGAAGGTAGCCCG GCTGGTTCTCCGACTTCTACTGAGGAAG GTACTTCTACCGAACCTTCCGAAGGTAG CGCTCCA | 509 | GTSTEPSEGSAPGTSESA TPESGPGTSTEPSEGSAP GTSTEPSEGSAPGTSESA TPESGPGTSESATPESGP GTPGSGTASSSPGASPGT SSTGSPGASPGTSSTGSP GSPAGSPTSTEEGSPAGS PTSTEEGTSTEPSEGSAP | 510 |
| LCW462_r28 | GGTAGCCCAGCAGGCTCTCCGACTTCCA CTGAGGAAGGTACTTCTACTGAACCTTCC GAAGGCAGCGCTCCAGGTACCTCTACTG AACCTTCTGAGGGCAGCGCTCCAGGTAC CTCTACCGAACCGTCTGAAGGTAGCGCA CCAGGTACCTCTGAAAGCGCAACTCCTG | 511 | GSPAGSPTSTEEGTSTEP SEGSAPGTSTEPSEGSAP GTSTEPSEGSAPGTSESA TPESGPGTSESATPESGP GTPGSGTASSSPGSSTPS GATGSPGASPGTSSTGSP | 512 |

TABLE 13-continued

DNA and amino acid sequences for AM144 segments

| Clone | Sequence Trimmed | SEQ ID NO: | Protein Sequence | SEQ ID NO: |
|---|---|---|---|---|
| | AGTCCGGTCCAGGTACTTCTGAAAGCGC AACCCCGGAGTCTGGCCCAGGTACCCCG GGTAGCGGTACTGCTTCTTCCTCTCCAGG TAGCTCTACCCCTTCTGGTGCAACCGGCT CTCCAGGTGCTTCTCCGGGCACCAGCTCT ACCGGTTCTCCAGGTACCTCTACTGAACC TTCTGAGGGCAGCGCTCCAGGTACTTCTG AAAGCGCTACCCCGGAGTCCGGTCCAGG TACTTCTACTGAACCGTCCGAAGGTAGC GCACCA | | GTSTEPSEGSAPGTSESA TPESGPGTSTEPSEGSAP | |
| LCW462_r38 | GGTAGCGAACCGGCAACCTCCGGCTCTG AAACTCCAGGTACTTCTGAAAGCGCTAC TCCGGAATCCGGCCCAGGTAGCGAACCG GCTACTTCCGGCTCTGAAACCCCAGGTA GCTCTACCCCGTCTGGTGCAACCGGCTCC CCAGGTACTCCTGGTAGCGGTACCGCTTC TTCTTCTCCAGGTAGCTCTACTCCGTCTG GTGCTACCGGCTCCCCAGGTGCATCTCCT GGTACCAGCTCTACCGGTTCTCCAGGTA GCTCTACTCCTTCTGGTGCTACTGGCTCT CCAGGTGCTTCCCCGGGTACCAGCTCTAC CGGTTCTCCAGGTAGCGAACCTGCTACTT CTGGTTCTGAAACTCCAGGTACTTCTACC GAACCGTCCGAGGGTAGCGCTCCAGGTA GCGAACCTGCTACTTCTGGTTCTGAAACT CCA | 513 | GSEPATSGSETPGTSESA TPESGPGSEPATSGSETP GSSTPSGATGSPGTPGSG TASSSPGSSTPSGATGSP GASPGTSSTGSPGSSTPS GATGSPGASPGTSSTGSP GSEPATSGSETPGTSTEP SEGSAPGSEPATSGSETP | 514 |
| LCW462_r39 | GGTACCTCTACTGAACCTTCCGAAGGCA GCGCTCCAGGTACCTCTACCGAACCGTC CGAGGGCAGCGCACCAGGTACTTCTGAA AGCGCAACCCCTGAATCCGGTTCCAGGTA GCCCTGCTGGCTCTCCGACTTCTACTGAG GAAGGTAGCCCGGCTGGTTCTCCGACTT CTACTGAGGAAGGTACTTCTACCGAACC TTCCGAAGGTAGCGCTCCAGGTAGCCCG GCTGGTTCTCCGACTTCCACCGAGGAAG GTACCTCTACTGAACCTTCTGAGGGTAGC GCTCCAGGTACCTCTACTGAACCTTCCGA AGGCAGCGCTCCAGGTGCTTCCCCGGGC ACCAGCTCTACTGGTTCTCCAGGTTCTAG CCCGTCTGCTTCTACTGGTACTGGTCCAG GTTCTAGCCCTTCTGCTTCCACTGGTACT GGTCCA | 515 | GTSTEPSEGSAPGTSTEP SEGSAPGTSESATPESGP GSPAGSPTSTEEGSPAGS PTSTEEGTSTEPSEGSAP GSPAGSPTSTEEGTSTEP SEGSAPGTSTEPSEGSAP GASPGTSSTGSPGSSPSA STGTGPGSSPSASTGTGP | 516 |
| LCW462_r41 | GGTAGCTCTACCCCGTCTGGTGCTACCGG TTCCCCAGGTGCTTCTCCTGGTACTAGCT CTACCGGTTCTCCAGGTAGCTCTACCCCG TCTGGTGCTACTGGCTCTCCAGGTAGCCC TGCTGGCTCTCCAACCTCCACCGAAGAA GGTACCTCTGAAAGCGCAACCCCTGAAT CCGGCCCAGGTAGCGAACCGGCAACCTC CGGTTCTGAAACCCCAGGTGCATCTCCTG GTACTAGCTACTGGTTCTCCAGGTAGC TCTACTCCGTCTGGTGCAACCGGCTCTCC AGGTTCTAGCCCTTCTGCATCTACCGGTA CTGGTCCAGGTTCTACCAGCGAATCCCCT TCTGGTACTGCTCCAGGTTCTACCAGCGA ATCCCCTTCTGGCACCGCACCAGGTACTT CTACCCCTGAAAGCGGCTCCGCTTCTCCA | 517 | GSSTPSGATGSPGASPGT SSTGSPGSSTPSGATGSP GSPAGSPTSTEEGTSESA TPESGPGSEPATSGSETP GASPGTSSTGSPGSSTPS GATGSPGSSPSASTGTGP GSTSESPSGTAPGSTSESP SGTAPGTSTPESGSASP | 518 |
| LCW462_r42 | GGTTCTACCAGCGAATCTCCTTCTGGCAC CGCTCCAGGTTCTACTAGCGAATCCCCGT CTGGTACCGCACCAGGTACTTCTCCTAGC GGCGAATCTTCTACCGCACCAGGTACCT CTGAAAGCGCTACTCCGGAGTCGGCCC AGGTACCTCTACTGAACCGTCTGAGGGT AGCGCTCCAGGTACTTCTACTGAACCGTC CGAAGGTAGCGCACCAGGTACCTCTACT GAACCTTCTGAGGGCAGCGCTCCAGGTA CTTCTGAAAGCGCTACCCCGGAGTCCGG TCCAGGTACTTCTACTGAACCGTCCGAA GGTAGCGCACCAGGTAGCTCTACCCCGT CTGGTGCTACCGGTTCCCCAGGTGCTTCT | 519 | GSTSESPSGTAPGSTSESP SGTAPGTSPSGESSTAPG TSESATPESGPGTSTEPSE GSAPGTSTEPSEGSAPGT STEPSEGSAPGTSESATP ESGPGTSTEPSEGSAPGS STPSGATGSPGASPGTSS TGSPGSSTPSGATGSP | 520 |

TABLE 13-continued

DNA and amino acid sequences for AM144 segments

| Clone | Sequence Trimmed | SEQ ID NO: | Protein Sequence | SEQ ID NO: |
|---|---|---|---|---|
| | CCTGGTACTAGCTCTACCGGTTCTCCAGG TAGCTCTACCCCGTCTGGTGCTACTGGCT CTCCA | | | |
| LCW462_r43 | GGTTCTACTAGCTCTACTGCAGAATCTCC GGGCCCAGGTACCTCTCCTAGCGGTGAA TCTTCTACCGCTCCAGGTACTTCTCCGAG CGGTGAATCTTCTACCGCTCCAGGTTCTA CTAGCTCTACCGCTGAATCTCCGGGTCCA GGTTCTACCAGCTCTACTGCAGAATCTCC TGGCCCAGGTACTTCTACTCCGGAAAGC GGTTCCGCTTCTCCAGGTACTTCTCCTAG CGGTGAATCTTCTACCGCTCCAGGTTCTA CCAGCTCTACTGCTGAATCTCCTGGCCCA GGTACTTCTACCCCGGAAAGCGGCTCCG CTTCTCCAGGTTCTACCAGCTCTACCGCT GAATCTCCTGGCCCAGGTTCTACTAGCG AATCTCCGTCTGGCACCGCACCAGGTAC TTCCCCTAGCGGTGAATCTTCTACTGCAC CA | 521 | GSTSSTAESPGPGTSPSG ESSTAPGTSPSGESSTAP GSTSSTAESPGPGTSST AESPGPGTSTPESGSASP GTSPSGESSTAPGSTSST AESPGPGTSTPESGSASP GSTSSTAESPGPGTSESP SGTAPGTSPSGESSTAP | 522 |
| LCW462_r45 | GGTACCTCTACTCCGGAAAGCGGTTCCG CATCTCCAGGTTCTACCAGCGAATCCCG TCTGGCACCGCACCAGGTTCTACTAGCTC TACTGCTGAATCTCCGGGCCCAGGTACCT CTACTGAACCTTCCGAAGGCAGCGCTCC AGGTACCTCTACCGAACCGTCCGAGGGC AGCGCACCAGGTACTTCTGAAAGCGCAA CCCCTGAATCCGGTCCAGGTACCTCTGA AAGCGCTACTCCGGAGTCTGGCCCAGGT ACCTCTACTGAACCGTCTGAGGGTAGCG CTCCAGGTACTTCTACTGAACGTCCGAA GGTAGCGCACCAGGTACTTCTGAAAGCG CTACTCCGGAGTCCGGTCCAGGTACCTCT ACCGAACCGTCCGAAGGCAGCGCTCCAG GTACTTCTACTGAACCTTCTGAGGGTAGC GCTCCC | 523 | GTSTPESGSASPGSTSESP SGTAPGSTSSTAESPGPG TSTEPSEGSAPGTSTEPSE GSAPGTSESATPESGPGT SESATPESGPGTSTEPSE GSAPGTSTEPSEGSAPGT SESATPESGPGTSTEPSE GSAPGTSTEPSEGSAP | 524 |
| LCW462_r47 | GGTACCTCTACCGAACCGTCCGAGGGTA GCGCACCAGGTACCTCTACTGAACCGTC TGAGGGTAGCGCTCCAGGTAGCGAACCG GCAACCTCCGGTTCTGAAACTCCAGGTA CTTCTACTGAACCGTCTGAAGGTAGCGC ACCAGGTACTTCTGAAAGCGCAACCCCG GAATCCGGCCCAGGTACCTCTGAAAGCG CAACCCCGGAGTCCGGCCCAGGTGCATC TCCGGGTACTAGCTCTACCGGTTCTCCAG GTTCTAGCCCTTCTGCTTCCACTGGTACC GGCCCAGGTAGCTCTACCCCGTCTGGTG CTACTGGTTCCCCAGGTAGCTCTACTCCG TCTGGTGCAACCGGTTCCCCAGGTAGCTC TACTCCTTCTGGTGCTACTGGCTCCCAG GTGCATCCCCTGGCACCAGCTCTACCGGT TCTCCA | 525 | GTSTEPSEGSAPGTSTEP SEGSAPGSEPATSGSETP GTSTEPSEGSAPGTSESA TPESGPGTSESATPESGP GASPGTSSTGSPGSSPSA STGTGPGSSTPSGATGSP GSSTPSGATGSPGSSTPS GATGSPGASPGTSSTGSP | 526 |
| LCW462_r54 | GGTAGCGAACCGGCAACCTCTGGCTCTG AAACTCCAGGTAGCGAACCTGCAACCTC CGGCTCTGAAACCCCAGGTACTTCTACTG AACCTTCTGAGGGCAGCGCACCAGGTAG CGAACCTGCAACCTCTGGCTCTGAAACC CCAGGTACCTCTGAAAGCGCTACTCCTG AATCTGGCCCAGGTACTTCTACTGAACC GTCCGAGGGCAGCGCACCAGGTAGCTCT ACTCCGTCTGGTGCTACCGGCTCTCCAGG TAGCTCTACCCCTTCTGGTGCAACCGGCT CCCCAGGTGCTTCTCCGGGTACCAGCTCT ACTGGTTCTCCAGGTAGCTCTACCCCGTC TGGTGCTACCGGTTCCCCAGGTGCTTCTC CTGGTACTAGCTCTACCGGTTCTCCAGGT AGCTCTACCCCGTCTGGTGCTACTGGCTC TCCA | 527 | GSEPATSGSETPGSEPAT SGSETPGTSTEPSEGSAP GSEPATSGSETPGTSESA TPESGPGTSTEPSEGSAP GSSTPSGATGSPGSSTPS GATGSPASPGTSSTGSP GSSTPSGATGSPASPGT SSTGSPGSSTPSGATGSP | 528 |
| LCW462_r55 | GGTACTTCTACCGAACCGTCCGAGGGCA GCGCTCCAGGTACTTCTACTGAACCTTCT | 529 | GTSTEPSEGSAPGTSTEP SEGSAPGTSTEPSEGSAP | 530 |

TABLE 13-continued

DNA and amino acid sequences for AM144 segments

| Clone | Sequence Trimmed | SEQ ID NO: | Protein Sequence | SEQ ID NO: |
|---|---|---|---|---|
| | GAAGGCAGCGCTCCAGGTACTTCTACTG AACCTTCCGAAGGTAGCGCACCAGGTAC TTCTGAAAGCGCTACTCCGGAGTCCGGT CCAGGTACCTCTACCGAACCGTCCGAAG GCAGCGCTCCAGGTACTTCTACTGAACCT TCTGAGGGTAGCGCTCCAGGTTCTACTA GCGAATCTCCGTCTGGCACTGCTCCAGGT ACTTCTCCTAGCGGTGAATCTTCTACCGC TCCAGGTACTTCCCCTAGCGGCGAATCTT CTACCGCTCCAGGTAGCCCGGCTGGCTCT CCTACCTCTACTGAGGAAGGTACTTCTGA AAGCGCTACTCCTGAGTCTGGTCCAGGT ACCTCTACTGAACCGTCCGAAGGTAGCG CTCCA | | GTSESATPESGPGTSTEP SEGSAPGTSTEPSEGSAP GSTSESPSGTAPGTSPSG ESSTAPGTSPSGESSTAP GSPAGSPTSTEEGTSESA TPESGPGTSTEPSEGSAP | |
| LCW462_r57 | GGTACTTCTACTGAACCTTCCGAAGGTA GCGCTCCAGGTAGCGAACCTGCTACTTCT GGTTCTGAAACCCCAGGTAGCCCGGCTG GCTCTCCGACCTCCACCGAGGAAGGTAG CCCGGCAGGCTCTCCGACCTCTACTGAG GAAGGTACTTCTGAAAGCGCAACCCCGG AGTCCGGCCCAGGTACCTCTACCGAACC GTCTGAGGGCAGCGCACCAGGTACCTCT ACTGAACCTTCCGAAGGCAGCGCTCCAG GTACCTCTACCGAACCGTCCGAGGGCAG CGCACCAGGTACTTCTGAAAGCGCAACC CCTGAATCCGGTCCAGGTAGCTCTACTCC GTCTGGTGCAACCGGCTCCCCAGGTTCTA GCCCGTCTGCTTCCACTGGTACTGGCCCA GGTGCTTCCCCGGGCACCAGCTCTACTG GTTCTCCA | 531 | GTSTEPSEGSAPGSEPAT SGSETPGSPAGSPTSTEE GSPAGSPTSTEEGTSESA TPESGPGTSTEPSEGSAP GTSTEPSEGSAPGTSTEP SEGSAPGTSESATPESGP GSSTPSGATGSPGSSPSA STGTGPGASPGTSSTGSP | 532 |
| LCW462_r61 | GGTAGCGAACCGGCTACTTCCGGCTCTG AGACTCCAGGTAGCCCTGCTGGCTCTCC GACCTCTACCGAAGAAGGTACCTCTGAA AGCGCTACCCCTGAGTCTGGCCCAGGTA CCTCTACTGAACCTTCCGAAGGCAGCGC TCCAGGTACCTCTACCGAACCGTCCGAG GGCAGCGCACCAGGTACTTCTGAAAGCG CAACCCCCTGAATCCGGTCCAGGTACCTCT ACTCGGAAAGCGGTTCCGCATCTCCAG GTTCTACCAGCGAATCCCCGTCTGGCACC GCACCAGGTTCTACTAGCTCTACTGCTGA ATCTCCGGGCCCAGGTACTTCTGAAAGC GCTACTCCGGAGTCCGGTCCAGGTACCT CTACCGAACCGTCCGAAGGCAGCGCTCC AGGTACTTCTACTGAACCTTCTGAGGGTA GCGCTCCA | 533 | GSEPATSGSETPGSPAGS PTSTEEGTSESATPESGP GTSTEPSEGSAPGTSTEP SEGSAPGTSESATPESGP GTSTPESGSASPGSTSESP SGTAPGSTSSTAESPGPG TSESATPESGPGTSTEPSE GSAPGTSTEPSEGSAP | 534 |
| LCW462_r64 | GGTACTTCTACCGAACCGTCCGAGGGCA GCGCTCCAGGTACTTCTACTGAACCTTCT GAAGGCAGCGCTCCAGGTACTTCTACTG AACCTTCCGAAGGTAGCGCACCAGGTAC CTCTACCGAACCGTCTGAAGGTAGCGCA CCAGGTACCTCTGAAAGCGCAACTCCTG AGTCCGGTCCAGGTACTTCTGAAAGCGC AACCCCGGAGTCTGGCCCAGGTACTCCT GGCAGCGGTACCGCATCTTCCTCTCCAG GTAGCTCTACTCCGTCTGGTGCAACTGGT TCCCCAGGTGCTTCTCCGGGTACCAGCTC TACCGGTTCTCCAGGTTCCACCAGCTCTA CTGCTGAATCTCCTGGTCCAGGTACCTCT CCTAGCGGTGAATCTTCTACTGCTCCAGG TACTTCTACTCCTGAAAGCGGCTCTGCTT CTCCA | 535 | GTSTEPSEGSAPGTSTEP SEGSAPGTSTEPSEGSAP GTSTEPSEGSAPGTSESA TPESGPGTSESATPESGP GTPGSGTASSSPGSSTPS GATGSPGASPGTSSTGSP GSTSSTAESPGPGTSPSG ESSTAPGTSTPESGSASP | 536 |
| LCW462_r67 | GGTAGCCCGGCAGGCTCTCCGACCTCTA CTGAGGAAGGTACTTCTGAAAGCGCAAC CCCGGAGTCCGGCCCAGGTACCTCTACC GAACCGTCTGAGGGCAGCGCACCAGGTA CTTCTGAAAGCGCAACCCCTGAATCCGG TCCAGGTAGCGAACCGGCTACTTCTGGC TCTGAGACTCCAGGTACTTCTACCGAACC GTCCGAAGGTAGCGCACCAGGTAGCCCG | 537 | GSPAGSPTSTEEGTSESA TPESGPGTSTEPSEGSAP GTSESATPESGPGSEPAT SGSETPGSTEPSEGSAP GSPAGSPTSTEEGTSTEP SEGSAPGTSTEPSEGSAP GTSTEPSEGSAPGTSTEP SEGSAPGTSTEPSEGSAP | 538 |

TABLE 13-continued

DNA and amino acid sequences for AM144 segments

| Clone | Sequence Trimmed | SEQ ID NO: | Protein Sequence | SEQ ID NO: |
|---|---|---|---|---|
| | GCTGGTTCTCCGACTTCCACCGAGGAAG GTACCTCTACTGAACCTTCTGAGGGTAGC GCTCCAGGTACCTCTACTGAACCTTCCGA AGGCAGCGCTCCAGGTACTTCTACCGAA CCGTCCGAGGGCAGCGCTCCAGGTACTT CTACTGAACCTTCTGAAGGCAGCGCTCC AGGTACTTCTACTGAACCTTCCGAAGGT AGCGCACCA | | | |
| LCW462_r69 | GGTACTTCTCCGAGCGGTGAATCTTCTAC CGCACCAGGTTCTACTAGCTCTACCGCTG AATCTCCGGGCCCAGGTACTTCTCCGAG CGGTGAATCTTCTACTGCTCCAGGTACCT CTGAAAGCGCTACTCCGGAGTCTGGCCC AGGTACCTCTACTGAACCGTCTGAGGGT AGCGCTCCAGGTACTTCTACTGAACCGTC CGAAGGTAGCGCACCAGGTTCTAGCCCT TCTGCATCTACTGGTACTGGCCCAGGTAG CTCTACTCCTTCTGGTGCTACCGGCTCTC CAGGTGCTTCTCCGGGTACTAGCTCTACC GGTTCTCCAGGTACTTCTACTCCGGAAAG CGGTTCCGCATCTCCAGGTACTTCTCCTA GCGGTGAATCTTCTACTGCTCCAGGTACC TCTCCTAGCGGCGAATCTTCTACTGCTCCA | 539 | GTSPSGESSTAPGSTSST AESPGPGTSPSGESSTAP GTSESATPESGPGTSTEP SEGSAPGTSTEPSEGSAP GSSPSASTGTGPGSSTPS GATGSPGASPGTSSTGSP GTSTPESGSASPGTSPSG ESSTAPGTSPSGESSTAP | 540 |
| LCW462_r70 | GGTACCTCTGAAAGCGCTACTCCGGAGT CTGGCCCAGGTACCTCTACTGAACCGTCT GAGGGTAGCGCTCCAGGTACTTCTACTG AACCGTCCGAAGGTAGCGCACCAGGTAG CCCTGCTGGCTCTCCGACTTCTACTGAGG AAGGTAGCCCGGCTGGTTCTCCGACTTCT ACTGAGGAAGGTACTTCTACCGAACCTT CCGAAGGTAGCGCTCCAGGTTCTAGCCCC TTCTGCTTCCACCGGTACTGGCCCAGGTA GCTCTACCCCTTCTGGTGCTACCGGCTCC CCAGGTAGCTCTACTCCTTCTGGTGCAAC TGGCTCTCCAGGTAGCGAACCGGCAACT TCCGGCTCTGAAACCCCAGGTACTTCTGA AAGCGCTACTCCTGAGTCTGGCCCAGGT AGCGAACCTGCTACCTCTGGCTCTGAAA CCCCA | 541 | GTSESATPESGPGTSTEP SEGSAPGTSTEPSEGSAP GSPAGSPTSTEEGSPAGS PTSTEEGTSTEPSEGSAP GSSPSASTGTGPGSSTPS GATGSPGSSTPSGATGSP GSEPATSGSETPGTSESA TPESGPGSEPATSGSETP | 542 |
| LCW462_r72 | GGTACTTCTACCGAACCGTCCGAAGGCA GCGCTCCAGGTACCTCTACTGAACCTTCC GAGGGCAGCGCTCCAGGTACCTCTACCG AACCTTCTGAAGGTAGCGCACCAGGTAG CTCTACCCCGTCTGGTGCTACCGGTTCCC CAGGTGCTTCTCCTGGTACTAGCTCTACC GGTTCTCCAGGTAGCTCTACCCCGTCTGG TGCTACTGGCTCTCCAGGTACTTCTGAAA GCGCAACCCCTGAATCCGGTCCAGGTAG CGAACCGGCTACTTCTGGCTCTGAGACTC CAGGTACTTCTACCGAACCGTCCGAAGG TAGCGCACCAGGTTCTACTAGCGAATCT CCTTCTGGCACTGCACCAGGTTCTACCAG CGAATCTCCGTCTGGCACTGCACCAGGT ACCTCTACCCCTGAAAGCGGTTCCGCTTC TCCA | 543 | GTSTEPSEGSAPGTSTEP SEGSAPGTSTEPSEGSAP GSSTPSGATGSPGASPGT SSTGSPGSSTPSGATGSP GTSESATPESGPGSEPAT SGSETPGTSTEPSEGSAP GSTSESPSGTAPGSTSESP SGTAPGTSTPESGSASP | 544 |
| LCW462_r73 | GGTACCTCTACTCCTGAAAGCGGTTCTGC ATCTCCAGGTTCCACTAGCTCTACCGCAG AATCTCCGGGCCCAGGTTCTACTAGCTCT ACTGCTGAATCTCCTGGCCCAGGTTCTAG CCCTTCTGCATCTACTGGTACTGGCCCAG GTAGCTCTACTCCTTCTGGTGCTACCGGC TCTCCAGGTGCTTCTCCGGGTACTAGCTC TACCGGTTCTCCAGGTAGCGAACCGGCA ACCTCCGGCTCTGAAACCCCAGGTACCT CTGAAAGCGCTACTCCTGAATCCGGCCC AGGTAGCCCGGCAGGTTCTCCGACTTCC ACTGAGGAAGGTTCTACTAGCGAATCTC CTTCTGGCACTGCACCAGGTTCTACCAGC GAATCTCCGTCTGGCACTGCACCAGGTA | 545 | GTSTPESGSASPGSTSST AESPGPGTSSTAESPGP GSSPSASTGTGPGSSTPS GATGSPGASPGTSSTGSP GSEPATSGSETPGTSESA TPESGPGSPAGSPTSTEE GSTSESPSGTAPGSTSESP SGTAPGTSTPESGSASP | 546 |

TABLE 13-continued

DNA and amino acid sequences for AM144 segments

| Clone | Sequence Trimmed | SEQ ID NO: | Protein Sequence | SEQ ID NO: |
|---|---|---|---|---|
| | CCTCTACCCCTGAAAGCGGTTCCGCTTCT CCC | | | |
| LCW462_r78 | GGTAGCCCGGCTGGCTCTCCTACCTCTAC TGAGGAAGGTACTTCTGAAAGCGCTACT CCTGAGTCTGGTCCAGGTACCTCTACTGA ACCGTCCGAAGGTAGCGCTCCAGGTTCT ACCAGCGAATCTCCTTCTGGCACCGCTCC AGGTTCTACTAGCGAATCCCCGTCTGGTA CCGCACCAGGTACTTCTCCTAGCGGCGA ATCTTCTACCGCACCAGGTACCTCTACCG AACCTTCCGAAGGTAGCGCTCCAGGTAG CCCGGCAGGTTCTCCTACTTCCACTGAGG AAGGTACTTCTACCGAACCTTCTGAGGG TAGCGCACCAGGTAGCGAACCTGCAACC TCTGGCTCTGAAACCCCAGGTACCTCTGA AAGCGCTACTCCTGAATCTGGCCCAGGT ACTTCTACTGAACCGTCCGAGGGCAGCG CACCA | 547 | GSPAGSPTSTEEGTSESA TPESGPGTSTEPSEGSAP GSTSESPSGTAPGTSESP SGTAPGTSPSGESSTAPG TSTEPSEGSAPGSPAGSP TSTEEGTSTEPSEGSAPG SEPATSGSETPGTSESAT PESGPGTSTEPSEGSAP | 548 |
| LCW462_r79 | GGTACCTCTACCGAACCTTCCGAAGGTA GCGCTCCAGGTAGCCCGGCAGGTTCTCC TACTTCCACTGAGGAAGGTACTTCTACCG AACCTTCTGAGGGTAGCGCACCAGGTAC CTCCCCTAGCGGCGAATCTTCTACTGCTC CAGGTACCTCTCCTAGCGGCGAATCTTCT ACCGCTCCAGGTACCTCCCCTAGCGGTG AATCTTCTACCGCACCAGGTTCTACCAGC GAATCCCCTTCTGGTACTGCTCCAGGTTC TACCAGCGAATCCCCTTCTGGCACCGCA CCAGGTACTTCTACCCCTGAAAGCGGCT CCGCTTCTCCAGGTAGCGAACCTGCAAC CTCTGGCTCTGAAACCCCAGGTACCTCTG AAAGCGCTACTCCTGAATCTGGCCCAGG TACTTCTACTGAACCGTCCGAGGGCAGC GCACCA | 549 | GTSTEPSEGSAPGSPAGS PTSTEEGTSTEPSEGSAP GTSPSGESSTAPGTSPSG ESSTAPGTSPSGESSTAP GSTSESPSGTAPGSTSESP SGTAPGTSTPESGSASPG SEPATSGSETPGTSESAT PESGPGTSTEPSEGSAP | 550 |
| LCW462_r87 | GGTAGCGAACCGGCAACCTCTGGCTCTG AAACCCCAGGTACCTCTGAAAGCGCTAC TCCGGAATCTGGTCCAGGTACTTCTGAA AGCGCTACTCCGGAATCCGGTCCAGGTA CTTCTCCGAGCGGTGAATCTTCTACCGCA CCAGGTTCTACTAGCTCTACCGCTGAATC TCCGGGCCCAGGTACTTCTCCGAGCGGT GAATCTTCTACTGCTCCAGGTTCTACTAG CGAATCCCCGTCTGGTACTGCTCCAGGTA CTTCCCCTAGCGGTGAATCTTCTACTGCT CCAGGTTCTACCAGCTCTACCGCAGAAT CTCCGGGTCCAGGTAGCTCTACTCCGTCT GGTGCAACCGGTTCCCCAGGTAGCTCTA CCCCTTCTGGTGCAACCGGCTCCCCAGGT AGCTCTACCCCTTCTGGTGCAAACTGGCT CTCC | 551 | GSEPATSGSETPGTSESA TPESGPGTSESATPESGP GTSPSGESSTAPGTSSST AESPGPGTSPSGESSTAP GSTSESPSGTAPGTSPSG ESSTAPGSTSSTAESPGP GSSTPSGATGSPGSSTPS GATGSPGSSTPSGANWLS | 552 |
| LCW462_r88 | GGTAGCCCTGCTGGCTCTCCGACTTCTAC TGAGGAAGGTAGCCCGGCTGGTTCTCCG ACTTCTACTGAGGAAGGTACTTCTACCG AACCTTCCGAAGGTAGCGCTCCAGGTAC CTCTACTGAACCTTCCGAAGGCAGCGCT CCAGGTACCTCTACCGAACCGTCCGAGG GCAGCGCACCAGGTACTTCTGAAAGCGC AACCCCTGAATCCGGTCCAGGTGCATCT CCTGGTACCAGCTCTACCGGTTCTCCAGG TAGCTCTACTCCTTCTGGTGCTACTGGCT CTCCAGGTGCTTCCCCGGGTACCAGCTCT ACCGGTTCTCCAGGTAGCTCTACCCCGTC TGGTGCTACTGGTTCTCAGGTACTCCGG GCAGCGGTACTGCTTCTTCCTCTCCAGGT AGCTCTACCCCTTCTGGTGCTACTGGCTC TCCA | 553 | GSPAGSPTSTEEGSPAGS PTSTEEGTSTEPSEGSAP GTSTEPSEGSAPGTSTEP SEGSAPGTSESATPESGP GASPGTSSTGSPGSSTPS GATGSPGASPGTSSTGSP GSSTPSGATGSPGTPGSG TASSSPGSSTPSGATGSP | 554 |
| LCW462_r89 | GGTAGCTCTACCCCGTCTGGTGCTACTGG TTCTCCAGGTACTCCGGGCAGCGGTACT GCTTCTTCCTCTCCAGGTAGCTCTACCCC | 555 | GSSTPSGATGSPGTPGSG TASSSPGSSTPSGATGSP GSPAGSPTSTEEGTSESA | 556 |

TABLE 13-continued

DNA and amino acid sequences for AM144 segments

| Clone | Sequence Trimmed | SEQ ID NO: | Protein Sequence | SEQ ID NO: |
|---|---|---|---|---|
|  | TTCTGGTGCTACTGGCTCTCCAGGTAGCC |  | TPESGPGTSTEPSEGSAP |  |
|  | CGGCTGGCTCTCCTACCTCTACTGAGGAA |  | GTSESATPESGPGSEPAT |  |
|  | GGTACTTCTGAAAGCGCTACTCCTGAGTC |  | SGSETPGTSESATPESGP |  |
|  | TGGTCCAGGTACCTCTACTGAACCGTCCG |  | GTSTEPSEGSAPGTSESA |  |
|  | AAGGTAGCGCTCCAGGTACCTCTGAAAG |  | TPESGPGTSESATPESGP |  |
|  | CGCAACTCCTGAGTCTGGCCCAGGTAGC |  |  |  |
|  | GAACCTGCTACCTCCGGCTCTGAGACTCC |  |  |  |
|  | AGGTACCTCTGAAAGCGCAACCCCGGAA |  |  |  |
|  | TCTGGTCCAGGTACTTCTACTGAACCGTC |  |  |  |
|  | TGAAGGTAGCGCACCAGGTACTTCTGAA |  |  |  |
|  | AGCGCAACCCCGGAATCCGGCCCAGGTA |  |  |  |
|  | CCTCTGAAAGCGCAACCCCGGAGTCCGG |  |  |  |
|  | CCCA |  |  |  |

Example 7

Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8

Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmid was isolated from cultures of *E. coli* harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM144 and XTEN_AM288. Screening of this library yielded 4 isolates that were selected for further construction

Example 9

Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 557) and the non-phosphorylated oligonucleotide BsaI-AscI-KpnIrev: CCTCGAGTGAAGACGAAC- CTCCCGTGCTTGGCGCGCCGCTTGCGCTTGC (SEQ ID NO: 558) for introducing the sequencing island A (SI-A) which encodes amino acids GASASGAPSTG (SEQ ID NO: 559) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in Example 5. This new library of XTEN_AM875 segment was designated LCW0481.

Example 10

Construction of XTEN_AM1318

We annealed the phosphorylated oligonucleotide BsaI-FseI-KpnIforP: AGGTCCAGAACCAACGGGGCCGGC-CCCAAGCGGAGGTTCGTCTTCACTCGAGGGTAC (SEQ ID NO: 560) and the non-phosphorylated oligonucleotide BsaI-FseI-KpnIrev: CCTCGAGTGAAGACGAAC-CTCCGCTTGGGGCCGGCCCCGTTGGTTCTGG (SEQ ID NO: 561) for introducing the sequencing island B (SI-B) which encodes amino acids GPEPTGPAPSG (SEQ ID NO: 562) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in Example 5. This new library of XTEN_AM443 segments was designated LCW0480.

We generated a library of XTEN_AM1318 segments by recombining segments from library LCW0480 of XTEN_AM443 segments and segments from library LCW0481 of XTEN_AM875 segments using the same dimerization process as in Example 5. This new library of XTEN_AM1318 segment was designated LCW0487.

Example 11

Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12

Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13

Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full-length clone of XTEN_AG864 had excellent solubility and showed half-life exceeding 60 h in cynomolgus monkeys.

Example 14

Construction of N-Terminal Extensions of XTEN-Construction and Screening of 12 mer Addition Libraries This example details a step in the optimization of the N-terminus of the XTEN protein to promote the initiation of translation to allow for expression of XTEN fusions at the N-terminus of fusion proteins without the presence of a helper domain. Historically expression of proteins with XTEN at the N-terminus was poor, yielding values that would essentially undetectable in the GFP fluorescence assay (<25% of the expression with the N-terminal CBD helper domain). To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stiffer vector pCW0551 (Stuffer-XTEN_AM875-GFP), and transformed into E. coli BL21Gold(DE3) competent cells to obtain colonies of seven libraries. The resulting clones have N-terminal XTEN 12 mers fused in-frame to XTEN_AM875-GFP to allow use of GFP fluorescence for screening the expression. Individual colonies from the seven created libraries were picked and grown overnight to saturation in 500 µl of super broth media in a 96 deep well plate. The number of colonies picked ranged from approximately half to a third of the theoretical diversity of the library (see Table 14).

TABLE 14

Theoretical Diversity and Sampling Numbers for 12mer Addition Libraries. The amino acid residues with randomized codons are underlined.

| Library | Motif Family | Amino Acid Sequence | SEQ ID NO: | Theoretical Diversity | Number screened |
|---|---|---|---|---|---|
| LCW546 | AE12 | MASPAGSPTSTEE | 563 | 572 | 2 plates (168) |
| LCW547 | AE12 | MATSESATPESGP | 564 | 1536 | 5 plates (420) |
| LCW548 | AF12 | MATSPSGESSTAP | 565 | 192 | 2 plates (168) |
| LCW549 | AF12 | MESTSSTAESPGP | 566 | 384 | 2 plates (168) |
| LCW552 | AG12 | MASSTPSGATGSP | 567 | 384 | 2 plates (168) |
| LCW553 | AG12 | MEASPGTSSTGSP | 568 | 384 | 2 plates (168) |
| LCW554 | (CBD-like) | MASTPESGSSG | 569 | 32 | 1 plate (84) |

Figure 28:
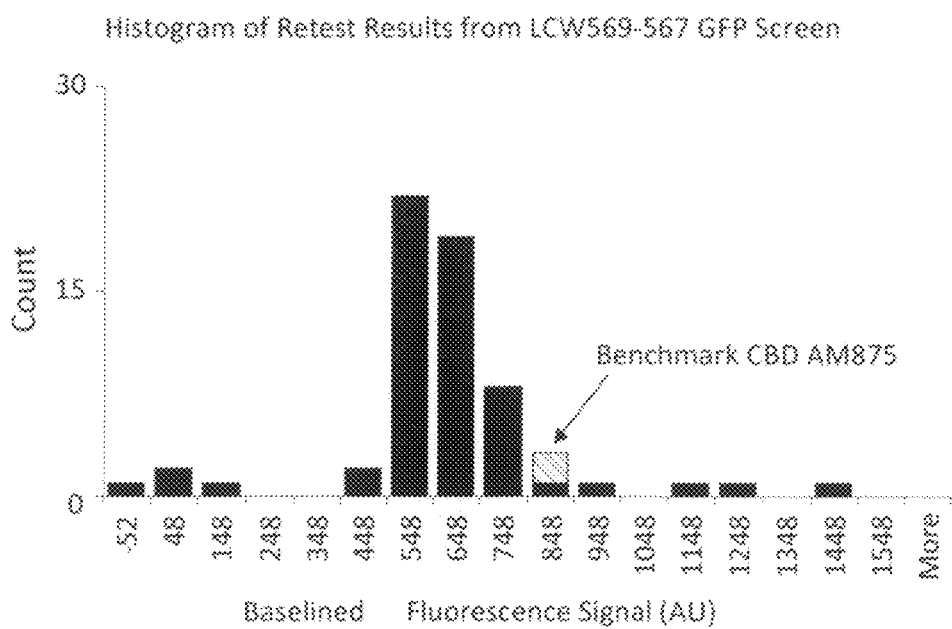
FIG. 28 shows a histogram of a retest of the top 75 clones after the optimization step, as described in Example 15, for GFP fluorescence signal, relative to the benchmark CBD_AM875 construct. The results indicated that several clones were now superior to the benchmark clones.

The saturated overnight cultures were used to inoculate fresh 500 µl cultures in auto-induction media in which they were grown overnight at 26° C. These expression cultures were then assayed using a fluorescence plate reader (excitation 395 nm, emission 510 nm) to determine the amount of GFP reporter present (see FIG. 28 for results of expression assays). The results indicated that while median expression levels were approximately half of the expression levels compared to the "benchmark" CBD N-terminal helper domain, the best clones from the libraries were much closer to the benchmarks, indicating that further optimization around those sequences was warranted. This is in contrast to previous XTEN versions that were <25% of the expression levels of the CBD N-terminal benchmark. The results also show that the libraries starting with amino acids MA had better expression levels than those beginning with ME. This was most apparent when looking at the best clones, which were closer to the benchmarks as they mostly start with MA. Of the 176 clones within 33% of the CBD-AM875 benchmark, 87% begin with MA, where as only 75% of the sequences in the libraries beginning with MA, a clear over representation of the clones beginning with MA at the highest level of expression. 96 of the best clones were sequenced to confirm identity and twelve sequences (see Table 15), 4 from LCW546, 4 from LCW547 and 4 from LCW552 were selected for further optimization.

TABLE 15

Advanced 12mer DNA Nucleotide Sequences

| Clone | DNA Nucleotide Sequence | SEQ ID NO: |
|---|---|---|
| LCW546_02 | ATGGCTAGTCCGGCTGGCTCTCCGACCTCCACTGAGGAAGGTACTTCTACT | 570 |
| LCW546_06 | ATGGCTAGTCCTGCTGGCTCTCCAACCTCCACTGAGGAAGGTACTTCTACT | 571 |
| LCW546_07 | ATGGCTAGTCCAGCAGGCTCTCCTACCTCCACCGAGGAAGGTACTTCTACT | 572 |
| LCW546_09 | ATGGCTAGTCCTGCTGGCTCTCCGACCTCTACTGAGGAAGGTACTTCTACT | 573 |
| LCW547_03 | ATGGCTACATCCGAAAGCGCAACCCCTGAGTCCGGTCCAGGTACTTCTACT | 574 |
| LCW547_06 | ATGGCTACATCCGAAAGCGCAACCCCTGAATCTGGTCCAGGTACTTCTACT | 575 |
| LCW547_10 | ATGGCTACGTCTGAAAGCGCTACTCCGGAATCTGGTCCAGGTACTTCTACT | 576 |
| LCW547_17 | ATGGCTACGTCCGAAAGCGCTACCCCTGAATCCGGTCCAGGTACTTCTACT | 577 |
| LCW552_03 | ATGGCTAGTTCTACCCCGTCTGGTGCAACCGGTTCCCCAGGTACTTCTACT | 578 |
| LCW552_05 | ATGGCTAGCTCCACTCCGTCTGGTGCTACCGGTTCCCCAGGTACTTCTACT | 579 |
| LCW552_10 | ATGGCTAGCTCTACTCCGTCTGGTGCTACTGGTTCCCCAGGTACTTCTACT | 580 |
| LCW552_11 | ATGGCTAGTTCTACCCCTTCTGGTGCTACTGGTTCTCCAGGTACTTCTACT | 581 |

Example 15

Construction of N-Terminal Extensions of XTEN-Construction and Screening of Libraries Optimizing Codons 3 and 4

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions (see FIG. 29). In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of three libraries LCW0569-571. With 24 XTEN codons the theoretical diversity of each library is 576 unique clones. A total of 504 individual colonies from the three created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples (see FIG. 28). 52 clones yielded usable sequencing data and were used for subsequent analysis. The results were broken down by library and indicate that LCW546 was the superior library. The results are presented in Table 16. Surprisingly, it was discovered that base-lined fluorescence readings for the best clones were ~900 AU, whereas the CBD N-terminal benchmark was only ~600 AU. This indicates that this library had instituted an approximately 33% improvement over the best clones from the previous library which were approximately equal in expression to the CBD N-terminal benchmark (Example 14).

TABLE 16

Third and Fourth Codon Optimization Library Comparison

|  | LCW569 | LCW570 | LCW571 |
|---|---|---|---|
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 17.

TABLE 17

Preferred Third and Fourth Codons in LCW569

|  | 3 = GAA | Rest | 4 = ACT | Rest |
|---|---|---|---|---|
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Example 16

Figure 29:
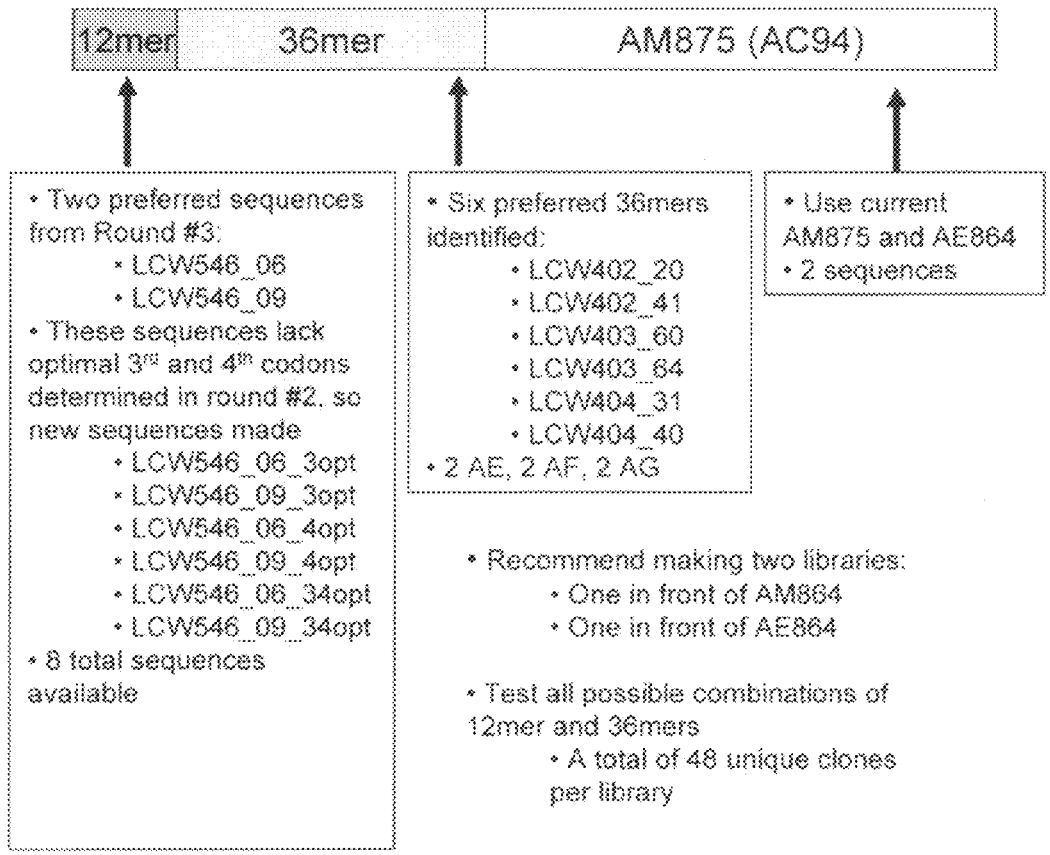
FIG. 29 is a schematic of a combinatorial approach undertaken for the union of codon optimization preferences for two regions of the N-terminus 48 amino acids (see Example 16 for experimental details). The approach created novel 48 mers at the N-terminus of the XTEN protein for evaluation of the optimization of expression that resulted in leader sequences that can be a solution for the expression of XTEN proteins where the XTEN is N-terminal to the CF.

Construction of N-Terminal Extensions of XTEN-Construction and Screening of Combinatorial 12 mer and 36 mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12 mer sequences (see Example supra) at the very N-terminus followed by 125 previously constructed 36 mer segments (see example supra) in a combinatorial manner. This created novel 48 mers at the N-terminus of the XTEN protein and enabled the assessment of the impact of longer-range interactions at the N-terminus on expression of the longer sequences (FIG. 29). Similar to the dimerization procedures used to assemble 36 mers (see Example infra), the plasmids containing the 125 selected 36 mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into E. coli BL21Gold(DE3) competent cells to obtain colonies of the library LCW0579, which also served as the vector for further cloning 12 selected 12 mers at the very N-terminus. The plasmids of LCW0579 were digested with NdeI/EcoRI/BsaI and the appropriate fragments were gel-purified. 12 pairs of oligonucleotides encoding 12 selected 12 mer sequences were designed, annealed and ligated with the NdeI/EcoRI/BsaI digested LCW0579 vector, and transformed into E. coli BL21Gold(DE3) competent cells to obtain colonies of the library LCW0580. With a theoretical diversity of 1500 unique clones, a total of 1512 individual colonies from the created library were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12 mer that was present in each clone and the impact of each 12 mer on expression was assessed. Clones LCW546_06 and LCW546_09 stood out as being the superior N-terminus (see Table 18).

TABLE 18

Relative Performance of Clones Starting with LCW546 06 and LCW459 09

|  | LCW546_06 | All Others | LCW546_09 | All Others |
|---|---|---|---|---|
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 19. It was noted that these were the only occurrences of these sequences and in no case did one of these sequences occur and fail to beat the bench-mark clone. These six sequences were advanced for further optimization.

TABLE 19

Combinatorial 12mer and 36mer Clones Superior to Benchmark Clone

| Clone Name | First 60 codons | SEQ ID NO: | 12mer Name | 36mer Name |
|---|---|---|---|---|
| LCW580_51 | ATGGCTAGTCCTGCTGGCTCTCCAACCTC CACTGAGGAAGGTGCATCCCCGGGCACC AGCTCTACCGGTTCTCCAGGTAGCTCTAC CCCGTCTGGTGCTACCGGCTCTCCAGGTA GCTCTACCCCGTCTGGTGCTACTGGCTCTC CAGGTACTTCTACTGAACCGTCTGAAGGC AGCGCA | 582 | LCW546_06 | LCW0404_040 |
| LCW580_81 | ATGGCTAGTCCTGCTGGCTCTCCAACCTC CACTGAGGAAGGTGCATCCCCGGGCACC AGCTCTACCGGTTCTCCAGGTAGCTCTAC CCCGTCTGGTGCTACCGGCTCTCCAGGTA GCTCTACCCCGTCTGGTGCTACTGGCTCTC CAGGTACTTCTACTGAACCGTCTGAAGGC AGCGCA | 583 | LCW546_06 | LCW0404_040 |

TABLE 19-continued

Combinatorial 12mer and 36mer Clones Superior to Benchmark Clone

| Clone Name | First 60 codons | SEQ ID NO: | 12mer Name | 36mer Name |
|---|---|---|---|---|
| LCW580_38 | ATGGCTAGTCCTGCTGGCTCTCCAACCTC<br>CACTGAGGAAGGTACTTCTACCGAACCGT<br>CCGAGGGTAGCGCACCAGGTAGCCCAGC<br>AGGTTCTCCTACCTCCACCGAGGAAGGTA<br>CTTCTACCGAACCGTCCGAGGGTAGCGCA<br>CCAGGTACTTCTACTGAACCGTCTGAAGG<br>CAGCGCA | 584 | LCW546_06 | LCW0402_041 |
| LCW580_63 | ATGGCTAGTCCTGCTGGCTCTCCGACCTC<br>TACTGAGGAAGGTACTTCTACTGAACCGT<br>CTGAAGGCAGCGCACCAGGTAGCGAACC<br>GGCTACTTCCGGTTCTGAAACCCCAGGTA<br>GCCCAGCAGGTTCTCCAACTTCTACTGAA<br>GAAGGTACTTCTACTGAACCGTCTGAAGG<br>CAGCGCA | 585 | LCW546_09 | LCW0402_020 |
| LCW580_06 | ATGGCTAGTCCTGCTGGCTCTCCAACCTC<br>CACTGAGGAAGGTACCCCGGGTAGCGGT<br>ACTGCTTCTTCCTCTCCAGGTAGCTCTACC<br>CCTTCTGGTGCAACCGGCTCTCCAGGTGC<br>TTCTCCGGGCACCAGCTCTACCGGTTCTC<br>CAGGTACTTCTACTGAACCGTCTGAAGGC<br>AGCGCA | 586 | LCW546_06 | LCW0404_031 |
| LCW580_35 | ATGGCTAGTCCTGCTGGCTCTCCGACCTC<br>TACTGAGGAAGGTACTTCTACTGAACCGT<br>CTGAAGGCAGCGCACCAGGTAGCGAACC<br>GGCTACTTCCGGTTCTGAAACCCCAGGTA<br>GCCCAGCAGGTTCTCCAACTTCTACTGAA<br>GAAGGTACTTCTACTGAACCGTCTGAAGG<br>CAGCGCA | 587 | LCW546_09 | LCW0402_020 |
| LCW580_67 | ATGGCTAGTCCTGCTGGCTCTCCGACCTC<br>TACTGAGGAAGGTACCTCCCCTAGCGGCG<br>AATCTTCTACTGCTCCAGGTACCTCTCCTA<br>GCGGCGAATCTTCTACCGCTCCAGGTACC<br>TCCCCTAGCGGTGAATCTTCTACCGCACC<br>AGGTACTTCTACTGAACCGTCTGAAGGCA<br>GCGCA | 588 | LCW546_09 | LCW0403_064 |
| LCW580_13 | ATGGCTAGTCCTGCTGGCTCTCCGACCTC<br>TACTGAGGAAGGTACCTCTACTCCGGAAA<br>GCGGTTCCGCATCTCCAGGTTCTACCAGC<br>GAATCCCCGTCTGGCACCGCACCAGGTTC<br>TACTAGCTCTACTGCTGAATCTCCGGGCC<br>CAGGTACTTCTACTGAACCGTCTGAAGGC<br>AGCGCA | 589 | LCW546_09 | LCW0403_060 |
| LCW580_88 | ATGGCTAGTCCTGCTGGCTCTCCGACCTC<br>TACTGAGGAAGGTACCTCCCCTAGCGGCG<br>AATCTTCTACTGCTCCAGGTACCTCTCCTA<br>GCGGCGAATCTTCTACCGCTCCAGGTACC<br>TCCCCTAGCGGTGAATCTTCTACCGCACC<br>AGGTACTTCTACTGAACCGTCTGAAGGCA<br>GCGCA | 590 | LCW546_09 | LCW0403_064 |
| LCW580_11 | ATGGCTAGTCCTGCTGGCTCTCCGACCTC<br>TACTGAGGAAGGTACCTCTACTCCGGAAA<br>GCGGTTCCGCATCTCCAGGTTCTACCAGC<br>GAATCCCCGTCTGGCACCGCACCAGGTTC<br>TACTAGCTCTACTGCTGAATCTCCGGGCC<br>CAGGTACTTCTACTGAACCGTCTGAAGGC<br>AGCGCA | 591 | LCW546_09 | LCW0403_060 |

Example 17

Construction of N-Terminal Extensions of XTEN-Construction and Screening of Combinatorial 12 mer and 36 mer Libraries for XTEN-AM875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12 mers and 36 mers (see Example supra) established, a combinatorial approach was undertaken to examine the union of these preferences. This created novel 48 mers at the N-terminus of the XTEN protein and enabled the testing of the confluence of previous conclusions. Additionally, the ability of these leader sequences to be a universal solution for all XTEN proteins was assessed by placing the new 48 mers in front of both XTEN-AE864 and XTEN-AM875. Instead of using all 125 clones of 36 mer segment, the plasmids from 6 selected clones of 36 mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (-XTEN_AM875-GFP) and LCW0586 (-XTEN_AE864-GFP), which could also serve as the vectors for further cloning 8 selected 12 mers at the very N-terminus The plasmids of LCW0585 and LCW0586 were digested with NdeI/EcoRI/BsaI and the appropriate fragments were gel-purified. 8 pairs of oligonucleotides encoding 8 selected 12 mer sequences with best GFP expression in the previous (Generation 2) screening were designed, annealed and ligated with the NdeI/EcoRI/BsaI digested LCW0585 and LCW0586 vectors, and transformed into E. coli BL21Gold(DE3) competent cells to obtain colonies of the final libraries LCW0587 (XTEN_AM923-GFP) and LCW0588 (XTEN_AE912-GFP). With a theoretical diversity of 48 unique clones, a total of 252 individual colonies from the created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12 mer, the third codon, the fourth codon and the 36 mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values approximately 50% greater than the benchmark controls (see Tables 20 and 21). These date support the conclusion that the inclusion of the sequences encoding the optimized N-terminal XTEN into the fusion protein genes conferred a marked enhancement on the expression of the fusion proteins.

TABLE 20

Preferred N-terminal Combinations for XTEN-AM875

| Clone Name | Number of Replicates | 12mer | 36mer | Mean | SD | CV |
| --- | --- | --- | --- | --- | --- | --- |
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 21

Preferred N-terminal Combinations for XTEN-AE864

| Clone Name | Number of Replicates | 12mer | 36mer | Mean | SD | CV |
| --- | --- | --- | --- | --- | --- | --- |
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Figure 30:
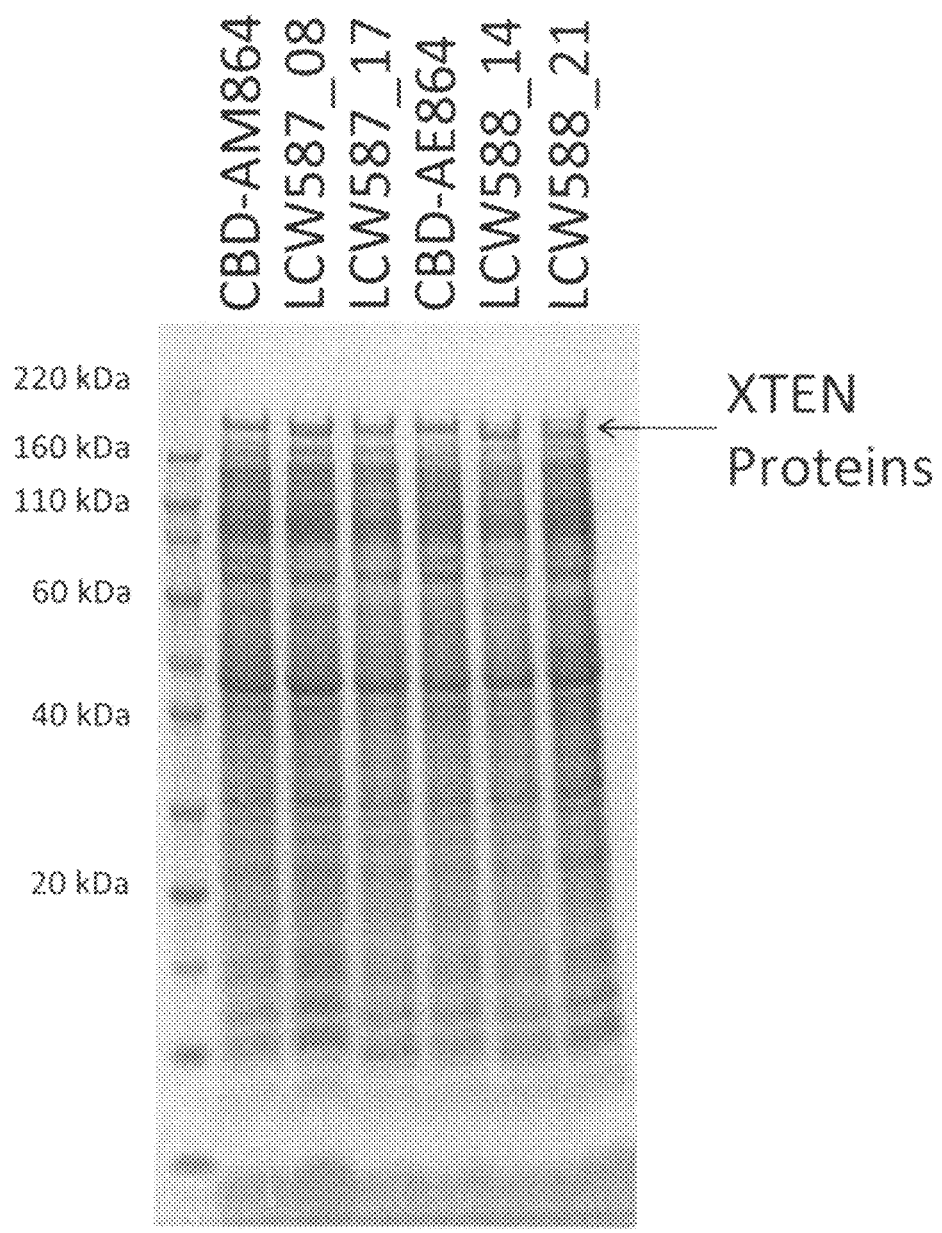
FIG. 30 shows an SDS-PAGE gel confirming the expression of preferred clones obtained from the XTEN N-terminal codon optimization experiments, in comparison to benchmark XTEN clones comprising CBD leader sequences at the N-terminus of the construct sequences, as described in Example 17.

Notably, the preferred combination of the N-terminal for the XTEN-AM875 and the preferred combination for the XTEN-AE864 are not the same, indicating more complex interactions further than 150 bases from the initiation site influence expression levels. The sequences for the preferred nucleotide sequences are listed in Table 22 and the preferred clones were analyzed by SDS-PAGE to independently confirm expression (see FIG. 30). The complete sequences of XTEN_AM923 and XTEN_AE912 were selected for further analysis.

TABLE 22

Preferred DNA Nucleotide Sequences for first 48 Amino Acid
Residues of N-terminal XTEN-AM875 and XTEN-AE864

| Clone Name | XTEN Modified | DNA Nucleotide Sequence | SEQ ID NO: |
|---|---|---|---|
| LCW587_08 | AM875 | ATGGCTGAACCTGCTGGCTCTCCAACCTCCACTGAGGAAGGTGCA TCCCCGGGCACCAGCTCTACCGGTTCTCCAGGTAGCTCTACCCCG TCTGGTGCTACCGGCTCTCCAGGTAGCTCTACCCCGTCTGGTGCT ACTGGCTCTCCAGGTACTTCTACTGAACCGTCTGAAGGCAGCGCA | 592 |
| LCW587_17 | AM875 | ATGGCTGAACCTGCTGGCTCTCCGACCTCTACTGAGGAAGGTACC TCCCCTAGCGGCGAATCTTCTACTGCTCCAGGTACCTCTCCTAGC GGCGAATCTTCTACCGCTCCAGGTACCTCCCCTAGCGGTGAATCT TCTACCGCACCAGGTACTTCTACTGAACCGTCTGAAGGCAGCGCA | 593 |
| LCW588_14 | AE864 | ATGGCTGAACCTGCTGGCTCTCCAACCTCCACTGAGGAAGGTACC CCGGGTAGCGGTACTGCTTCTTCCTCTCCAGGTAGCTCTACCCCTT CTGGTGCAACCGGCTCTCCAGGTGCTTCTCCGGGCACCAGCTCTA CCGGTTCTCCAGGTAGCCCGGCTGGCTCTCCTACCTCTACTGAG | 594 |
| LCW588_27 | AE864 | ATGGCTGAAACTGCTGGCTCTCCAACCTCCACTGAGGAAGGTGCA TCCCCGGGCACCAGCTCTACCGGTTCTCCAGGTAGCTCTACCCCG TCTGGTGCTACCGGCTCTCCAGGTAGCTCTACCCCGTCTGGTGCT ACTGGCTCTCCAGGTAGCCCGGCTGGCTCTCCTACCTCTACTGAG | 595 |

Example 18

Methods of Producing and Evaluating CFXTEN; XTEN-CF as Example

A general schema for producing and evaluating CFXTEN compositions is presented in FIG. 33, and forms the basis for the general description of this Example. Using the disclosed methods and those known to one of ordinary skill in the art, together with guidance provided in the illustrative examples, a skilled artesian can create and evaluate a range of CFXTEN fusion proteins comprising, XTENs, CF and variants of CF known in the art. The Example is, therefore, to be construed as merely illustrative, and not limitative of the methods in any way whatsoever; numerous variations will be apparent to the ordinarily skilled artisan. In this Example, a CFXTEN of coagulation factor linked to an XTEN of the AE family of motifs is created.

The general scheme for producing polynucleotides encoding XTEN is presented in FIGS. 31 and 32. FIG. 32 is a schematic flowchart of representative steps in the assembly of a XTEN polynucleotide construct in one of the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. The motif libraries can be limited to specific sequence XTEN families; e.g., AD, AE, AF, AG, AM, or AQ sequences of Table 3. In this case, the motifs of the AE family are used as the motif library, which are annealed to the 12-mer to create a "building block" length; e.g., a segment that encodes 36 amino acids. The gene encoding the XTEN sequence can be assembled by ligation and multimerization of the "building blocks" until the desired length of the XTEN gene 504 is achieved. As illustrated in FIG. 32, the XTEN length in this case is 48 amino acid residues, but longer lengths can be achieved by this process. For example, multimerization can be performed by ligation, overlap extension, PCR assembly or similar cloning techniques known in the art. The XTEN gene can be cloned into a stuffer vector. In the example illustrated in FIG. 32, the vector can encode a Flag sequence 506 followed by a stuffer sequence that is flanked by BsaI, BbsI, and KpnI sites 507 and a CF gene (e.g., FVII) 508, resulting in the gene encoding the CFXTEN 500, which, in this case encodes the fusion protein in the configuration, N- to C-terminus, XTEN-FVII. As is apparent to one of ordinary skill in the art, the methods can be applied to create constructs in alternative configurations and with varying XTEN lengths.

DNA sequences encoding CF can be conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. A gene or polynucleotide encoding the CF portion of the protein or its complement can be then be cloned into a construct, such as those described herein, which can be a plasmid or other vector under control of appropriate transcription and translation sequences for high level protein expression in a biological system. A second gene or polynucleotide coding for the XTEN portion or its complement (in the case of FIG. 32 illustrated as an XTEN with 48 amino acid residues) can be genetically fused to the nucleotides encoding the terminus of the CF gene by cloning it into the construct adjacent and in frame with the gene coding for the CF, through a ligation or multimerization step. In this manner, a chimeric DNA molecule coding for (or complementary to) the CFXTEN fusion protein Re generated within the construct. Optionally, a gene encoding for a second XTEN are inserted and ligated in-frame to the nucleotides encoding the opposite terminus of the CFXTEN gene or can be inserted within the CF-encoding region. The construct can be designed in different configurations to encode the various permutations of the fusion partners as a monomeric polypeptide. For example, the gene can be created to encode the fusion protein in the order (N- to C-terminus): CF-XTEN; XTEN-CF; CF-XTEN-CF; XTEN-CF-XTEN; as well as multimers of the foregoing. Optionally, this chimeric DNA molecule is transferred or cloned into another construct that is a more appropriate expression vector. At this point, a host cell capable of expressing the chimeric DNA molecule is transformed with the chimeric DNA molecule. The vectors containing the DNA segments of interest can be transferred into an appropriate host cell by well-known methods, depending on the type of cellular host, as described supra.

Host cells containing the XTEN-CF expression vector is cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, culture broth is harvested and separated from the cell mass and the resulting crude extract retained for purification of the fusion protein.

Gene expression are measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression is measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal. Conveniently, the antibodies may be prepared against the CF sequence polypeptide using a synthetic peptide based on the sequences provided herein or against exogenous sequence fused to CF and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The CFXTEN polypeptide product is purified via methods known in the art. Procedures such as gel filtration, affinity purification, salt fractionation, ion exchange chromatography, size exclusion chromatography, hydroxyapatite adsorption chromatography, hydrophobic interaction chromatography or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

As illustrated in FIG. 33, the isolated CFXTEN fusion proteins would then be characterized for their chemical and activity properties. Isolated fusion protein is characterized, e.g., for sequence, purity, apparent molecular weight, solubility and stability using standard methods known in the art. The fusion protein meeting expected standards would then be evaluated for activity, which can be measured in vitro or in vivo by measuring one of the coagulation factor-associated parameters described herein, using one or more assays disclosed herein, or using the assays of the Examples or Table 40.

In addition, the XTEN-CF fusion protein is administered to one or more animal species to determine standard pharmacokinetic parameters and pharmacodynamic properties, as described in Examples 30-33.

By the iterative process of producing, expressing, and recovering CFXTEN constructs, followed by their characterization using methods disclosed herein or others known in the art, the CFXTEN compositions comprising CF and an XTEN can be produced and evaluated by one of ordinary skill in the art to confirm the expected properties such as enhanced solubility, enhanced stability, improved pharmacokinetics and reduced immunogenicity, leading to an overall enhanced therapeutic activity compared to the corresponding unfused CF. For those fusion proteins not possessing the desired properties, a different sequence can be constructed, expressed, isolated and evaluated by these methods in order to obtain a composition with such properties.

Example 19

Construction of Expression Plasmids for FVII-XTEN

Construction of FVII-TEV-XTEN 864 Expression Vectors

The cloning vector containing the gene encoding FVII was purchased from OriGene (SC109205). PCR reactions were performed to abolish BbsI and BsaI restriction sites within the FVII coding region. The resulting FVII coding region was then amplified using primers that introduced NheI and TEV-BsaI sequences on the 5' and 3' end respectively. The digested FVII fragment was fused to BsaI/HindIII digested XTEN_AE864 fragment and inserted into NheI/HindIII digested pSecTag2C expression vector. The ligated DNA mixture was electroporated into XL1-Blue bacterial cells. Transformants were screened by DNA miniprep and the desired constructs were confirmed by DNA sequencing. The final construct is pCW0647.001 which encodes the FVII-TEV-XTEN_AE864 protein (Table 23).

Construction of FVII-XTEN 864 Expression Vectors

FVII was amplified with pCW0647.001 as a template. The PCR primers introduced NheI and BsaI restriction enzyme recognition sequences on the 5' and 3' end respectively and deleted the TEV site. The NheI/BsaI digested FVII fragment was fused to BsaI/HindIII digested XTEN_AE864 fragment and inserted into NheI/HindIII digested pSecTag2C expression vector. The ligated DNA mixture was electroporated into XL1-Blue bacterial cells. Transformants were screened by DNA miniprep and the desired constructs were confirmed by DNA sequencing. The final construct is pCW0645.001 which encodes the FVII-XTEN_AE864 protein (Table 23).

Construction of Expression Vectors Encoding FVII-XTEN 864 Genes Using Millipore Plasmids Expression vector pCW0645.001 was digested with NheI and SalI. The resulting 4091 bp fragment included nucleotides that encode the FVII-XTEN_AE864 protein. This fragment was ligated with NheI/SalI digested CET1019-AS-puro, CET1019-HS-puro, SC AS-puro, or DC HS-puro (licensed from Millipore). These vectors feature a CMV promoter that lies upstream of the gene insertion site, and the CET1019 vectors also contain a UCOE element upstream of the promoter. The ligated DNA mixture was electroporated into XL1-Blue bacterial cells. Transformants were screened by DNA miniprep and the desired constructs were confirmed by DNA sequencing. The resulting expression vectors were AC397 (pBC0013, SC AS puro-FVII-XTEN_AE864), AC402 (pBC0014, SC HS puro-FVII-XTEN_AE864), AC403 (pBC0015, CET1019 AS puro-FVII-XTEN_AE864), and AC404 (pBC0016, CET1019 HS puro-FVII-XTEN_AE864)

Construction of Expression Vectors Encoding FVII-XTEN 288 Genes

Expression vector pCW0645.001 was digested with BsaI and HindIII. The resulting 6400 bp fragment was ligated with BsaI/HindIII digested XTEN_AE288 fragment. The ligated DNA mixture was electroporated into XL1-Blue bacterial cells. Transformants were screened by DNA miniprep and the desired constructs were confirmed by DNA sequencing. The resulting expression vector was pBC0019 (pSecTag2C-FVII-XTEN_AE288).

Expression vector pBC0019 was digested with NheI and SalI. The resulting 2363 bp fragment included nucleotides that encode the FVII-XTEN_AE288 protein. This fragment was ligated with NheI/SalI digested CET1019-AS-puro, or CET1019-HS-puro (licensed from Millipore). These vectors feature a CMV promoter and a UCOE element that lie upstream of the gene insertion site. The ligated DNA mixture was electroporated into XL1-Blue bacterial cells. Transformants were screened by DNA miniprep and the desired constructs were confirmed by DNA sequencing. The resulting expression vectors were AC405 (pBC0017, CET1019 AS puro-FVII-XTEN_AE288), and AC398 (pBC0018, CET1019 HS puro-FVII-XTEN_AE288) (Table 23).

TABLE 23

FVII amino acid and nucleic acid sequences

| Name | Amino Acid Sequence | SEQ ID NO: | Nucleic Acid Sequence | SEQ ID NO: |
|---|---|---|---|---|
| FVII-TEV-XTEN_AE864, pCW0647.001 | MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSENLYFQGGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGTSESATPESGPGTSTEPSEGSAPGTSTEPSEGSATSESATPESGPGTSEPATSGSETPGTSESATPESGPGSEPATSGSETPGTSTEPSEGSAPGTSTEPSEPSEGSAPGTSTEPSEPSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGSPSEPATSGSETPGTSESATPESGPGTST | 596 | ATGGTCTCCCAGGCCCTCAGGCTCCTCTGCCTTCTGCTTGGGCTTCAGGGCTGCCTGGCTGCAGTGTTCGTAACCCAGGAGGAAGCCCACGGCGTCCTGCACCGGCGCCGGCGCGCCAACGCGTTCCTGGAGGAGCTACGGCCGGGCTCCCTGGAGAGGGAGTGCAAGGAGGAGCAGTGCTCCTTCGAGGAGGCCCGGGAGATCTTCAAGGACGCGGAGAGGACGAAGCTGTTCTGGATTTCTTACAGTGATGGGGACCAGTGTGCCTCAAGTCCATGCCAGAATGGGGGCTCCTGCAAGGACCAGCTCCAGTCCTATATCTGCTTCTGCCTCCCTGCCTTCGAGGGCCGGAACTGTGAGACGCACAAGGATGACCAGCTGATCTGTGTGAACGAGAACGGCGGCTGTGAGCAGTACTGCAGTGACCACACGGGCACCAAGCGCTCCTGTCGGTGCCACGAGGGGTACTCTCTGCTGGCAGACGGGGTGTCCTGCACACCCACAGTTGAATATCCATGTGGAAAAATACCTATTCTAGAAAAAAGAAATGCCAGCAAACCCCAAGGCCGAATTGTGGGGGGCAAGGTGTGCCCCAAAGGGAGTGTCCATGGCAGGTCCTGTTGTTGGTGAATGGAGCTCAGTTGTGTGGGGGGACCCTGATCAACACCATCTGGGTGGTCTCCGCGGCCCACTGTTTCGACAAAATCAAGAACTGGAGGAACCTGATCGCGGTGCTGGGCGAGCACGACCTCAGCGAGCACGACGGGGATGAGCAGAGCCGGCGGGTGGCGCAGGTCATCATCCCCAGCACGTACGTCCCGGGCACCACCAACCACGACATCGCGCTGCTCCGCCTGCACCAGCCCGTGGTCCTCACTGACCATGTGGTGCCCCTCTGCCTGCCCGAACGGACGTTCTCTGAGAGGACGCTGGCCTTCGTGCGCTTCTCATTGGTCAGCGGCTGGGGCCAGCTGCTGGACCGTGGCGCCACGGCCCTGAGCTCATGGTCCTCAACGTGCCCCGGCTGATGACCCAGGACTGCCTGCAGCAGTCACGGAAGGTGGGAGACTCCCCAAATATCACGGAGTACATGTTCTGTGCCGGCTACTCGGATGGCAGCAAGGACTCCTGCAAGGGGGACAGTGGAGGCCCACATGCCACCCACTACCGGGGCACGTGGTACCTGACGGGCATCGTCAGCTGGGGCCAGGGCTGCGCAACCGTGGGCCACTTTGGGGTGTACACCAGGGTCTCCCAGTACATCGAGTGGCTGCAAAAGCTCATGCGCTCAGAGCCACGCCCAGGAGTCCTCCTGCGAGCCCCATTTCCCGGCCCAGAAGGCCCATCCGAAAATCTGTATTTTCAGGTGGGTCTCCAGGTTCTCCAGCCGGGTCCCCAACTTCGACCGAGGAAGGGACCTCCGAGTCAGCTACCCCGGAGTCCGGTCCTGGCACCTCCACCGAACCATCGGAGGGCAGCGCCCTGGGAGCCCTGCCGGGAGCCCTACAAGCACCGAAGAGGGCACCAGTACAGAGCCAAGTGAGGGGAGCGCCCCTGGTACTAGTACTGAACCATCCGAGGGGTCAGCTCCAGGCACGAGTGAGTCCGCTACCCCGAGAGCGGACCGGGCTCAGAGCCCGCCACGAGTGGCAGTGAAACTCCAGGCTCAGAACCCGCCACTAGTGGGCAGAGACTCCAGGCAGCCCTGCCGGATCCCCTACGTCCACCGAGGAGGGAACATCTGAGTCCGCAACACCCGAATCCGGTCCAGG | 597 |

TABLE 23-continued

FVII amino acid and nucleic acid sequences

| Name | Amino Acid Sequence | SEQ ID NO: | Nucleic Acid Sequence | SEQ ID NO: |
|---|---|---|---|---|
| | EPSEGSAPGSPAGSPTST | | CACCTCCACGGAACCTAGTGAAGGCTC | |
| | EEGTSESATPESGPGSEP | | GGCACCAGGTACAAGCACCGAACCTAG | |
| | ATSGSETPGTSESATPES | | CGAGGGCAGCGCTCCCGGCAGCCCTGC | |
| | GPGSPAGSPTSTEEGSP | | CGGCAGCCCAACCTCAACTGAGGAGGG | |
| | AGSPTSTEEGTSTEPSE | | CACCAGTACTGAGCCCAGCGAGGGATC | |
| | GSAPGTSESATPESGPG | | AGCACCTGGCACCAGCACCGAACCTAG | |
| | TSESATPESGPGTSESAT | | CGAGGGGAGCGCCCCTGGGACTAGCGA | |
| | PESGPGSEPATSGSETP | | GTCAGCTACACCAGAGAGCGGGCCTGG | |
| | GSEPATSGSETPGSPAG | | AACTTCTACCGAACCCAGTGAGGGATCC | |
| | SPTSTEEGTSTEPSEGSA | | GCTCCAGGCACCTCCGAATCCGCAACCC | |
| | PGTSTEPSEGSAPGSEP | | CCGAATCCGGACCTGGCTCAGAGCCCG | |
| | ATSGSETPGTSESATPES | | CCACCAGCGGGAGCGAAACCCCTGGCA | |
| | GPGTSTEPSEGSAPGSSS | | CATCCACCGAGCCTAGCGAAGGGTCCG | |
| | | | CACCCGGCACCAGTACAGAGCCTAGCG | |
| | | | AGGGATCAGCACCTGGCACCAGTGAAT | |
| | | | CTGCTACACCAGAGAGCGGGCCCTGGAA | |
| | | | CCTCCGAGTCCGCTACCCCCGAGAGCGG | |
| | | | GCCAGGTTCTCCTGCTGGCTCCCCCACC | |
| | | | TCAACAGAAGAGGGGACAAGCGAAAGC | |
| | | | GCTACGCCTGAGAGTGGCCCTGGCTCTG | |
| | | | AGCCAGCCACCTCCGGCTCTGAAACCCC | |
| | | | TGGCACTAGTGAGTCTGCCACGCCTGAG | |
| | | | TCCGGACCCGGGACCTCTACTGAGCCCT | |
| | | | CGGAGGGGAGCGCTCCTGGCACGAGTA | |
| | | | CAGAACCTTCCGAAGGAAGTGCACCGG | |
| | | | GCACAAGCACCGAGCCTTCCGAAGGCT | |
| | | | CTGCTCCCGGAACCTCTACCGAACCCTC | |
| | | | TGAAGGGTCTGCACCCGGCACGAGCAC | |
| | | | CGAACCCAGCGAAGGGTCAGCGCCTGG | |
| | | | GACCTCAACAGAGCCCTCGGAAGGATC | |
| | | | AGCGCCTGGAAGCCCTGCAGGGAGTCC | |
| | | | AACTTCCACGGAAGAAGGAACGTCTAC | |
| | | | AGAGCCATCAGAGGGGTCCGCACCAGG | |
| | | | TACCAGCGAATCCGCTACTCCCGAATCT | |
| | | | GGCCCTGGGTCCGAACCTGCCACCTCCG | |
| | | | GCTCTGAAACTCCAGGGACCTCCGAATC | |
| | | | TGCCACACCCGAGAGCGGCCCTGGCTCC | |
| | | | GAGCCCGCAACATCTGGCAGCGAGACA | |
| | | | CCTGGCACCTCCGAGAGCGCAACACCC | |
| | | | GAGAGCGGCCCTGGCACCAGCACCGAG | |
| | | | CCATCCGAGGGATCCGCCCCAGGCACTT | |
| | | | CTGAGTCAGCCACACCCGAAAGCGGAC | |
| | | | CAGGATCACCCGCTGGCTCCCCCACCAG | |
| | | | TACCGAGGAGGGGTCCCCCGCTGGAAG | |
| | | | TCCAACAAGCACTGAGGAAGGGTCCCC | |
| | | | TGCCGGCTCCCCCACAAGTACCGAAGA | |
| | | | GGGCACAAGTGAGAGCGCCACTCCCGA | |
| | | | GTCCGGGCCTGGCACCAGCACAGAGCC | |
| | | | TTCCGAGGGGTCCGCACCAGGTACCTCA | |
| | | | GAGTCTGCTACCCCCGAGTCAGGGCCA | |
| | | | GGATCAGAGCCAGCCACCTCCGGGTCT | |
| | | | GAGACACCCGGGACTTCCGAGAGTGCC | |
| | | | ACCCCTGAGTCCGGACCCGGGTCCGAG | |
| | | | CCCGCCACTTCCGGCTCCGAAACTCCCG | |
| | | | GCACAAGCGAGAGCGCTACCCCAGAGT | |
| | | | CAGGACCAGGAACATCTACAGAGCCCT | |
| | | | CTGAAGGCTCCGCTCCAGGGTCCCCAGC | |
| | | | CGGCAGTCCCACTAGCACCGAGGAGGG | |
| | | | AACCTCTGAAAGCGCCACACCCGAATC | |
| | | | AGGGCCAGGGTCTGAGCCTGCTACCAG | |
| | | | CGGCAGCGAGACACCAGGCACCTCTGA | |
| | | | GTCCGCCACACCAGAGTCCGGACCCGG | |
| | | | ATCTCCCGCTGGGAGCCCCACCTCCACT | |
| | | | GAGGAGGGATCTCCTGCTGGCTCTCCAA | |
| | | | CATCTACTGAGGAAGGTACCTCAACCG | |
| | | | AGCCATCCGAGGGATCAGCTCCCGGCA | |
| | | | CCTCAGAGTCGGCAACCCCGGAGTCTG | |
| | | | GACCCGGAACTTCCGAAAGTGCCACAC | |
| | | | CAGAGTCCGGTCCCGGGACTTCAGAATC | |
| | | | AGCAACACCCGAGTCCGGCCCTGGGTCT | |
| | | | GAACCCGCCACAAGTGGTAGTGAGACA | |
| | | | CCAGGATCAGAACCTGCTACCTCAGGGT | |
| | | | CAGAGACACCCGGATCTCCGGCAGGCT | |
| | | | CACCAACCTCCACTGAGGAGGGCACCA | |

TABLE 23-continued

FVII amino acid and nucleic acid sequences

| Name | Amino Acid Sequence | SEQ ID NO: | Nucleic Acid Sequence | SEQ ID NO: |
|---|---|---|---|---|
| | | | GCACAGAACCAAGCGAGGGCTCCGCAC CCGGAACAAGCACTGAACCCAGTGAGG GTTCAGCACCCGGCTCTGAGCCGGCCAC AAGTGGCAGTGAGACACCCGGCACTTC AGAGAGTGCCACCCCCGAGAGTGGCCC AGGCACTAGTACCGAGCCCTCTGAAGG CAGTGCGCCAGGTTCGTCTTCATAA | |
| FVII-XTEN_AE864, pCW0645.001 | MVSQALRLLCLLLGLQ GCLAAVFVTQEEAHGV LHRRRRANAFLEELRP GSLERECKEEQCSFEEA REIFKDAERTKLFWISY SDGDQCASSPCQNGGS CKDQLQSYICFCLPAFE GRNCETHKDDQLICVN ENGGCEQYCSDHTGTK RSCRCHEGYSLLADGV SCTPTVEYPCGKIPILEK RNASKPQGRIVGGKVC PKGECPWQVLLLVNGA QLCGGTLINTIWVVSAA HCFDKIKNWRNLIAVL GEHDLSEHDGDEQSRR VAQVIIPSTYVPGTTNH DIALLRLHQPVVLTDH VVPLCLPERTFSERTLA FVRFSLVSGWGQLLDR GATALELMVLNVPRLM TQDCLQQSRKVGDSPNI TEYMFCAGYSDGSKDS CKGDSGGPHATHYRGT WYLTGIVSWGQGCATV GHFGVYTRVSQYIEWL QKLMRSEPRPGVLLRA PFPGSPGSPAGSPTSEE GTSESATPESGPGTSTEP SEGSAPGSPAGSPTSTE EGTSTEPSEGSAPGTST EPSEGSAPGTSESATPES GPGSEPATSGSETPGSE PATSGSETPGSPAGSPTS TEEGTSESATPESGPGT STEPSEGSAPGTSTEPSE GSAPGSPAGSPTSTEEG TSTEPSEGSAPGTSTEPS EGSAPGTSESATPESGP GTSTEPSEGSAPGTSES ATPESGPGSEPATSGSE TPGTSTEPSEGSAPGTST EPSEGSAPGTSESATPES GPGTSESATPESGPGSP AGSPTSTEEGTSESATP ESGPGSEPATSGSETPG TSESATPESGPGTSTEPS EGSAPGTSTEPSEGSAP GTSTEPSEGSAPGTSTEP SEGSAPGTSTEPSEGSA PGTSTEPSEGSAPGSPA GSPTSTEEGTSTEPSEGS APGTSESATPESGPGSE PATSGSETPGTSESATPE SGPGSEPATSGSETPGT SESATPESGPGTSTEPSE GSAPGTSESATPESGPG TSESATPESGPGSPAGS PTSTEEGSPAGSPTSTEE GTSESATPESGPGTSTEP SEGSAPGTSESATPESG PGSEPATSGSETPGTSES ATPESGPGSEPATSGSE TPGTSESATPESGPGTST EPSEGSAPGSPAGSPTST EEGTSESATPESGPGSEP | 598 | ATGGTCTCCCAGGCCCTCAGGCTCCTCT GCCTTCTGCTTGGGCTTCAGGGCTGCCT GGCTGCAGTGTTCGTAACCCAGGAGGA AGCCCACGGCGTCCTGCACCGGCGCCG GCGCGCCAACGCGTTCCTGGAGGAGCT ACGGCCGGGCTCCCTGGAGAGGGAGTG CAAGGAGGAGCAGTGCTCCTTCGAGGA GGCCCGGGAGATCTTCAAGGACGCGGA GAGGACGAAGCTGTTCTGGATTTCTTAC AGTGATGGGGACCAGTGTGCCTCAAGT CCATGCCAGAATGGGGGCTCCTGCAAG GACCAGCTCCAGTCCTATATCTGCTTCT GCCTCCCTGCCTTCGAGGGCCGGAACTG TGAGACGCACAAGGATGACCAGCTGAT CTGTGTGAACGAGAACGGCGGCTGTGA GCAGTACTGCAGTGACCACACGGGCAC CAAGCGCTCCTGTCGGTGCCACGAGGG GTACTCTCTGCTGGCAGACGGGGTGTCC TGCACACCCACAGTTGAATATCCATGTG GAAAAATACCTATTCTAGAAAAAAGAA ATGCCAGCAAACCCCAAGGCCGAATTG TGGGGGGCAAGGTGTGCCCCAAAGGGG AGTGTCCATGGCAGGTCCTGTTGTTGGT GAATGGAGCTCAGTTGTTGTGGGGGGAC CGATCAACACCATCTGGGTGGTCTCCG CGGCCCACTGTTTCGACAAAATCAAGA ACTGGAGGAACCTGATCGCGGTGCTGG GCGAGCACGACCTCAGCGAGCACGACG GGGATGAGCAGAGCCGGCGGGTGGCGC AGGTCATCATCCCCAGCACGTACGTCCC GGGCACCACCAACCACGACATCGCGCT GCTCCGCCTGCACCAGCCCGTGGTCCTC ACTGACCATGTGGTGCCCCTCTGCCTGC CCGAACGGACGTTCTCTGAGAGGACGC TGGCCTTCGTGCGCTTCTCATTGGTCAG CGGCTGGGGCCAGCTGCTGGACCGTGG CGCCACGGCCCTGGAGCTCATGGTCCTC AACGTGCCCCGGCTGATGACCCAGGAC TGCCTGCAGCAGTCACGGAAGGTGGGA GACTCCCCAAATATCACGGAGTACATGT TCTGTGCCGGCTACTCGGATGGCAGCAA GGACTCCTGCAAGGGGGACAGTGGAGG CCCACATGCCACCCACTACCGGGGCAC GTGGTACCTGACGGGCATCGTCAGCTGG GGCCAGGGCTGCGCAACCGTGGGCCAC TTTGGGGTGTACACCAGGGTCTCCCAGT ACATCGAGTGGCTGCAAAAGCTCATGC GCTCAGAGCCACGCCCAGGAGTCCTCCT GCGAGCCCCATTTCCCGGAGGTAGCCCG GCTGGCTCTCCTACCTCTACTGAGGAAG GTACTTCTGAAAGCGCTACTCCTGAGTC TGGTCCAGGTACCTCTACTGAACCGTCC GAAGGTAGCGCTCCAGGTAGCCCAGCA GGCTCTCCGACTTCCACTGAGGAAGGTA CTTCTACTGAACCTTCCGAAGGCAGCGC ACCAGGTACCTCTACTGAACCTTCTGAG GGCAGCGCTCCAGGTACTTCTGAAAGC GCTACCCCGGAATCTGGCCCAGGTAGC GAACCGGCTACTTCTGGTTCTGAAACCC CAGGTAGCGAACCGGCTACCTCCGGTTC TGAAACTCCAGGTAGCCCGGCAGGCTCT CCGACCTCTACTGAGGAAGGTACTTCTG AAAGCGCAACCCCGGAGTCCGGCCCAG GTACCTCTACCGAACCGTCTGAGGGCAG CGCACCAGGTACTTCTACCGAACCGTCC GAGGGTAGCGCACCAGGTAGCCCAGCA | 599 |

TABLE 23-continued

FVII amino acid and nucleic acid sequences

| Name | Amino Acid Sequence | SEQ ID NO: | Nucleic Acid Sequence | SEQ ID NO: |
|------|---------------------|------------|----------------------|------------|
| | ATSGSETPGTSESATPES GPGSPAGSPTSTEEGSP AGSPTSTEEGTSTEPSE GSAPGTSESATPESGPG TSESATPESGPGTSESAT PESGPGSEPATSGSETP GSEPATSGSETPGSPAG SPTSTEEGTSTEPSEGSA PGTSTEPSEGSAPGSEP ATSGSETPGTSESATPES GPGTSTEPSEGSAPGSSS | | GGTTCTCCTACCTCCACCGAGGAAGGTA CTTCTACCGAACCGTCCGAGGGTAGCGC ACCAGGTACCTCTACTGAACCTTCTGAG GGCAGCGCTCCAGGTACTTCTGAAAGC GCTACCCCGGAGTCCGGTCCAGGTACTT CTACTGAACCGTCCGAAGGTAGCGCAC CAGGTACTTCTGAAAGCGCAACCCCTGA ATCCGGTCCAGGTAGCGAACCGGCTACT TCTGGCTCTGAGACTCCAGGTACTTCTA CCGAACCGTCCGAAGGTAGCGCACCAG GTACTTCTACTGAACCGTCTGAAGGTAG CGCACCAGGTACTTCTGAAAGCGCAAC CCCGGAATCCGGCCCAGGTACCTCTGAA AGCGCAACCCCGGAGTCCGGCCCAGGT AGCCCTGCTGGCTCTCCAACCTCCACCG AAGAAGGTACCTCTGAAAGCGCAACCC CTGAATCCGGCCCAGGTAGCGAACCGG CAACCTCCGGTTCTGAAACCCCAGGTAC CTCTGAAAGCGCTACTCCGGAGTCTGGC CCAGGTACCTCTACTGAACCGTCTGAGG GTAGCGCTCCAGGTACTTCTACTGAACC GTCCGAAGGTAGCGCACCAGGTACTTCT ACCGAACCGTCCGAAGGCAGCGCTCCA GGTACCTCTACTGAACCTTCCGAGGGCA GCGCTCCAGGTACCTCTACCGAACCTTC TGAAGGTAGCGCACCAGGTACTTCTACC GAACCGTCCGAGGGTAGCGCACCAGGT AGCCCAGCAGGTTCTCCTACCTCCACCG AGGAAGGTACTTCTACCGAACCGTCCG AGGGTAGCGCACCAGGTACCTCTGAAA GCGCAACTCCTGAGTCTGGCCCAGGTAG CGAACCTGCTACCTCCGGCTCTGAGACT CCAGGTACCTCTGAAAGCGCAACCCCG GAATCTGGTCCAGGTAGCGAACCTGCA ACCTCTGGCTCTGAAACCCCAGGTACCT CTGAAAGCGCTACTCCTGAATCTGGCCC AGGTACTTCTACTGAACCGTCCGAGGGC AGCGCACCAGGTACTTCTGAAAGCGCT ACTCCTGAGTCCGGCCCAGGTAGCCCGG CTGGCTCTCCGACTTCCACCGAGGAAGG TAGCCCGGCTGGCTCTCCAACTTCTACT GAAGAAGGTAGCCCGGCAGGCTCTCCG ACCTCTACTGAGGAAGGTACTTCTGAAA GCGCAACCCCGGAGTCCGGCCCAGGTA CCTCTACCGAACCGTCTGAGGGCAGCGC ACCAGGTACCTCTGAAAGCGCAACTCCT GAGTCTGGCCCAGGTAGCGAACCTGCT ACCTCCGGCTCTGAGACTCCAGGTACCT CTGAAAGCGCAACCCCGGAATCTGGTC CAGGTAGCGAACCTGCAACCTCTGGCTC TGAAACCCCAGGTACCTCTGAAAGCGCT ACTCCTGAATCTGGCCCAGGTACTTCTA CTGAACCGTCCGAGGGCAGCGCACCAG GTAGCCCTGCTGGCTCTCCAACCTCCAC CGAAGAAGGTACCTCTGAAAGCGCAAC CCCTGAATCCGGCCCAGGTAGCGAACC GGCAACCTCCGGTTCTGAAACCCCAGGT ACTTCTGAAAGCGCTACTCCTGAGTCCG GCCCAGGTAGCCCGGCTGGCTCTCCGAC TTCCACCGAGGAAGGTAGCCCGGCTGG CTCTCCAACTTCTACTGAAGAAGGTACT TCTACCGAACCTTCCGAGGGCAGCGCAC CAGGTACTTCTGAAAGCGCTACCCCTGA GTCCGGCCCAGGTACTTCTGAAAGCGCT ACTCCTGAATCCGGTCCAGGTACTTCTG AAAGCGCTACCCCGGAATCTGGCCCAG GTAGCGAACCGGCTACTTCTGGTTCTGA AACCCCAGGTAGCGAACCGGCTACCTC CGGTTCTGAAACTCCAGGTAGCCCAGCA GGCTCTCCGACTTCCACTGAGGAAGGTA CTTCTACTGAACCTTCCGAAGGCAGCGC ACCAGGTACCTCTACTGAACCTTCTGAG GGCAGCGCTCCAGGTAGCGAACCTGCA ACCTCTGGCTCTGAAACCCCAGGTACCT | |

TABLE 23-continued

FVII amino acid and nucleic acid sequences

| Name | Amino Acid Sequence | SEQ ID NO: | Nucleic Acid Sequence | SEQ ID NO: |
|---|---|---|---|---|
| | | | CTGAAAGCGCTACTCCTGAATCTGGCCC AGGTACTTCTACTGAACCGTCCGAGGGC AGCGCACCAGGTTAA | |
| FVII-XTEN_AE288, pBC0019 | MVSQALRLLCLLLGLQ GCLAAVFVTQEEAHGV LHRRRRANAFLEELRP GSLERECKEEQCSFEEA REIFKDAERTKLFWISY SDGDQCASSPCQNGGS CKDQLQSYICFCLPAFE GRNCETHKDDQLICVN ENGGCEQYCSDHTGTK RSCRCHEGYSLLADGV SCTPTVEYPCGKIPILEK RNASKPQGRIVGGKVC PKGECPWQVLLLVNGA QLCGGTLINTIWVVSAA HCFDKIKNWRNLIAVL GEHDLSEHDGDEQSRR VAQVIIPSTYVPGTTNH DIALLRLHQPVVLTDH VVPLCLPERTFSERTLA FVRFSLVSGWGQLLDR GATALELMVLNVPRLM TQDCLQQSRKVGDSPNI TEYMFCAGYSDGSKDS CKGDSGGPHATHYRGT WYLTGIVSWGQGCATV GHFGVYTRVSQYIEWL QKLMRSEPRPGVLLRA PFPGSPGTSESATPESGP GSEPATSGSETPGTSES ATPESGPGSEPATSGSE TPGTSESATPESGPGTST EPSEGSAPGSPAGSPTST EEGTSESATPESGPGSEP ATSGSETPGTSESATPES GPGSPAGSPTSTEEGSP AGSPTSTEEGTSTEPSE GSAPGTSESATPESGPG TSESATPESGPGTSESAT PESGPGSEPATSGSETP GSEPATSGSETPGSPAG SPTSTEEGTSTEPSEGSA PGTSTEPSEGSAPGSEP ATSGSETPGTSESATPES GPGTSTEPSEGSAPGSSS | 600 | ATGGTGTCCCAGGCCCTCAGGCTCCTCT GCCTTCTGCTTGGGCTTCAGGGCTGCCT GGCTGCAGTGTTCGTAACCCAGGAGGA AGCCCACGGCGTCCTGCACCGGCGCCG GCGCGCCAACGCGTTCCTGGAGGAGCT ACGGCCGGGCTCCCTGGAGAGGGAGTG CAAGGAGGAGCAGTGCTCCTTCGAGGA GGCCCGGGAGATCTTCAAGGACGCGGA GAGGACGAAGCTGTTCTGGATTTCTTAC AGTGATGGGGACCAGTGTGCCTCAAGT CCATGCCAGAATGGGGGCTCCTGCAAG GACCAGCTCCAGTCCTATATCTGCTTCT GCCTCCCTGCCTTCGAGGGCCGGAACTG TGAGACGCACAAGGATGACCAGCTGAT CTGTGTGAACGAGAACGGCGGCTGTGA GCAGTACTGCAGTGACCACACGGGCAC CAAGCGCTCCTGTCGGTGCCACGAGGG GTACTCTCTGCTGGCAGACGGGGTGTCC TGCACACCCACAGTTGAATATCCATGTG GAAAAATACCTATTCTAGAAAAAAGAA ATGCCAGCAAACCCCAAGGCCGAATTG TGGGGGGCAAGGTGTGCCCCAAAGGGG AGTGTCCATGGCAGGTCCTGTTGTTGGT GAATGGAGCTCAGTTGTGTGGGGGGAC CCTGATCAACACCATCTGGGTGGTGTCC GCGGCCCACTGTTTCGACAAAATCAAG AACTGGAGAACCTGATCGCGGTGCTGG GCGAGCACGACCTCAGCGAGCACGACG GGGATGAGCAGAGCCGGCGGGTGGCGC AGGTCATCATCCCCAGCACGTACGTCCC GGGCACCACCAACCACGACATCGCGCT GCTCCGCCTGCACCAGCCCGTGGTCCTC ACTGACCATGTGGTGCCCCTCTGCCTGC CCGAACGACGTTCTCTGAGAGGACGC TGGCCTTCGTGCGCTTCTCATTGGTCAG CGGCTGGGGCCAGCTGCTGGACCGTGG CGCCACGGCCCTGGAGCTCATGGTCCTC AACGTGCCCCGGCTGATGACCCAGGAC TGCCTGCAGCAGTCACGGAAGGTGGGA GACTCCCCAAATATCACGGAGTACATGT TCTGTGCCGGCTACTCGGATGGCAGCAA GGACTCCTGCAAGGGGGACAGTGGAGG CCCACATGCCACCCACTACCGGGGCAC GTGGTACCTGACGGGCATCGTCAGCTGG GGCCAGGGCTGCGCAACCGTGGGCCAC TTTGGGGTGTACACCAGGGTGTCCCAGT ACATCGAGTGGCTGCAAAAGCTCATGC GCTCAGAGCCACGCCCAGGAGTCCTCCT GCGAGCCCCATTTCCCGGGTCTCCAGGT ACCTCAGAGTCTGCTACCCCGAGTCAG GGCCAGGATCAGAGCCAGCCACCTCCG GGTCTGAGACACCCGGGACTTCCGAGA GTGCCACCCCTGAGTCCGGACCCGGGTC CGAGCCCGCCACTTCCGGCTCCGAAACT CCCGGCACAAGCGAGAGCGCTACCCCA GAGTCAGGACCAGGAACATCTACAGAG CCCTCTGAAGGCTCCGCTCCAGGGTCCC CAGCCGGCAGTCCCACTAGCACCGAGG AGGGAACCTCTGAAAGCGCCACACCCG AATCAGGGCCAGGGTCTGAGCCTGCTA CCAGCGGCAGCGAGACACCAGGCACCT CTGAGTCCGCCACACCAGAGTCCGGAC CCGGATCTCCCGCTGGGAGCCCCACCTC CACTGAGGAGGGATCCTGCTGGCTCT CCAACATCTACTGAGGAAGGTACCTCA ACCGAGCCATCCGAGGGATCAGCTCCC GGCACCTCAGAGTCGGCAACCCCGGAG TCTGGACCCGGAACTTCCGAAAGTGCCA CACCAGAGTCCGGTCCCGGGACTTCAG AATCAGCAACACCCGAGTCCGGCCCTG | 601 |

TABLE 23-continued

FVII amino acid and nucleic acid sequences

| Name | Amino Acid Sequence | SEQ ID NO: | Nucleic Acid Sequence | SEQ ID NO: |
|------|---------------------|------------|-----------------------|------------|
|      |                     |            | GGTCTGAACCCGCCACAAGTGGTAGTG AGACACCAGGATCAGAACCTGCTACCT CAGGGTCAGAGACACCCGGATCTCCGG CAGGCTCACCAACCTCCACTGAGGAGG GCACCAGCACAGAACCAAGCGAGGGCT CCGCACCCGGAACAAGCACTGAACCCA GTGAGGGTTCAGCACCCGGCTCTGAGCC GGCCACAAGTGGCAGTGAGACACCCGG CACTTCAGAGAGTGCCACCCCCGAGAG TGGCCCAGGCACTAGTACCGAGCCCTCT GAAGGCAGTGCGCCAGGTTCGTCTTCAT AA |            |

Example 20

Construction of Expression Plasmids for FIX-XTEN

Construction of FIX-XTEN 864 Genes and Vectors

The cloning vector containing the gene encoding FIX was purchased from OriGene (SC126517). PCR reactions were performed to abolish two BbsI restriction sites within the FIX coding region. The resulting FIX coding region was then amplified using primers that introduced NheI and BsaI restriction enzyme recognition sequences on the 5' and 3' end respectively. The digested FIX fragment was fused to BsaI/HindIII digested XTEN_AM864, AE864, AF864, or AG864 fragments and inserted into NheI/HindIII digested pSecTag2C expression vector. The final constructs are AC282 (pCW0562, FIX-XTEN_AM864), AC283 (pCW0563, FIX-XTEN_AE864), pCW0564 (FIX-XTEN_AF864), and pCW0565 (FIX-XTEN_AG864) (Table 24).

Construction of Expression Vectors for FIX Helper Genes

The cloning vector containing the gene encoding PC5 was purchased from OriGene (SC310051). The PC5 coding region was amplified using primers that introduced NotI and BstBI restriction enzyme recognition sequences. The NotI/BstBI digested PC5 fragment was ligated with NotI/BstBI digested CET1019-HD-puro or DC-HD-puro vectors. Both CET1019-HD-puro and DC-HD-puro feature dual cassettes where a CMV promoter lies upstream of the gene insertion site, CET1019-HD-puro also contains a UCOE element upstream of the promoter. The ligated DNA mixture was electroporated into XL1-Blue bacterial cells. Transformants were screened by DNA miniprep and the desired constructs were confirmed by DNA sequencing. The resulting expression vectors are pBC0037 (DC-HD-puro-PC5) and pBC0038 (CET1019 HD-puro-PC5).

Construction of FIX-XTEN and PC5 Dual Expression Vectors

The pBC0037 and pBC0038 constructs were digested with NheI and SalI and ligated with the NheI/SalI digested FIX-XTEN_AE864. The ligated DNA mixture was electroporated into XL1-Blue bacterial cells. Transformants were screened by DNA miniprep and the desired constructs were confirmed by DNA sequencing. The resulting expression vectors were pBC0035 (DC-HD-puro-FIX-XTEN_AE864-PC5) and pBC0036 (CET1019-HD-puro-FIX-XTEN_AE864-PC5).

TABLE 24

FIX amino acid and nucleic acid sequences

| Name | Amino Acid Sequence | SEQ ID NO: | Nucleic Acid Sequences | SEQ ID NO: |
|------|---------------------|------------|------------------------|------------|
| FIX-XTEN_AM864, pCW0562 | MQRVNMIMAESPGLITI CLLGYLLSAECTVFLDH ENANKILNRPKRYNSG KLEEFVQGNLERECME EKCSFEEAREVFENTER TTEFWKQYVDGDQCES NPCLNGGSCKDDINSYE CWCPFGFEGKNCELDV TCNIKNGRCEQFCKNS ADNKVVCSCTEGYRLA ENQKSCEPAVPFPCGRV SVSQTSKLTRAETVFPD VDYVNSTEAETILDNIT QSTQSFNDFTRVVGGE DAKPGQFPWQVVLNG KVDAFCGGSIVNEKWI VTAAHCVETGVKITVV AGEHNIEETEHTEQKRN VIRIIPHHNYNAAINKY NHDIALLELDEPLVLNS YVTPICIADKEYTNIFLK FGSGYVSGWGRVFHKG | 602 | ATGCAGCGCGTGAACATGATCAT GGCAGAATCACCAGGCCTCATCA CCATCTGCCTTTTAGGATATCTAC TCAGTGCTGAATGTACAGTTTTTC TTGATCATGAAAACGCCAACAAA ATTCTGAATCGGCCAAAGAGGTA TAATTCAGGTAAATTGGAAGAGT TTGTTCAAGGGAACCTTGAGAGA GAATGTATGGAAGAAAGTGTA GTTTTGAAGAAGCACGAGAAGTT TTTGAAAACACTGAAAGAACAAC TGAATTTTGGAAGCAGTATGTTG ATGGAGATCAGTGTGAGTCCAAT CCATGTTTAAATGGCGGCAGTTG CAAGGATGACATTAATTCCTATG AATGTTGGTGTCCCTTTGGATTTG AAGGAAAGAACTGTGAATTAGAT GTAACATGTAACATTAAGAATGG CAGATGCGAGCAGTTTTGTAAAA ATAGTGCTGATAACAAGGTGGTT TGCTCCTGTACTGAGGGATATCG ACTTGCAGAAACCAGAAGTCCT | 603 |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | RSALVLQYLRVPLVDR | | GTGAACCAGCAGTGCCATTTCCA | |
| | ATCLRSTKFTIYNNMFC | | TGTGGAAGAGTTTCTGTTTCACA | |
| | AGFHEGGRDSCQGDSG | | AACTTCTAAGCTCACCCGTGCTG | |
| | GPHVTEVEGTSFLTGIIS | | AGACTGTTTTCCTGATGTGGACT | |
| | WGEECAMKGKYGIYT | | ATGTAAATTCTACTGAAGCTGAA | |
| | KVSRYVNWIKEKTKLT | | ACCATTTTGGATAACATCACTCA | |
| | GGTSTEPSEGSAPGSEP | | AAGCACCCAATCATTTAATGACT | |
| | ATSGSETPGSPAGSPTS | | TCACTCGGGTTGTTGGTGGAGAA | |
| | TEEGSTSSTAESPGPGTS | | GATGCCAAACCAGGTCAATTCCC | |
| | TPESGSASPGSTSESPSG | | TTGGCAGGTTGTTTTGAATGGTA | |
| | TAPGSTSESPSGTAPGT | | AAGTTGATGCATTCTGTGGAGGC | |
| | STPESGSASPGTSTPESG | | TCTATCGTTAATGAAAAATGGAT | |
| | SASPGSEPATSGSETPG | | TGTAACTGCTGCCCACTGTGTTG | |
| | TSESATPESGPGSPAGSP | | AAACTGGTGTTAAAATTACAGTT | |
| | TSTEEGTSTEPSEGSAP | | GTCGCAGGTGAACATAATATTGA | |
| | GTSESATPESGPGTSTEP | | GGAGACAGAACATACAGAGCAA | |
| | SEGSAPGTSTEPSEGSA | | AAGCGAAATGTGATTCGAATTAT | |
| | PGSPAGSPTSTEEGTSTE | | TCCTCACCACAACTACAATGCAG | |
| | PSEGSAPGTSTEPSEGS | | CTATTAATAAGTACAACCATGAC | |
| | APGTSESATPESGPGTS | | ATTGCCCTTCTGGAACTGGACGA | |
| | ESATPESGPGTSTEPSEG | | ACCCTTAGTGCTAAACAGCTACG | |
| | SAPGTSTEPSEGSAPGT | | TTACACCTATTTGCATTGCTGACA | |
| | SESATPESGPGTSTEPSE | | AGGAATACACGAACATCTTCCTC | |
| | GSAPGSEPATSGSETPG | | AAATTTGGATCTGGCTATGTAAG | |
| | SPAGSPTSTEEGSSTPSG | | TGGCTGGGGAAGAGTCTTCCACA | |
| | ATGSPGTPGSGTASSSP | | AAGGGAGATCAGCTTTAGTTCTT | |
| | GSSTPSGATGSPGTSTE | | CAGTACCTTAGAGTTCCACTTGTT | |
| | PSEGSAPGTSTEPSEGS | | GACCGAGCCACATGTCTTCGATC | |
| | APGSEPATSGSETPGSP | | TACAAAGTTCACCATCTATAACA | |
| | AGSPTSTEEGSPAGSPT | | ACATGTTCTGTGCTGGCTTCCATG | |
| | STEEGTSTEPSEGSAPG | | AAGGAGGTAGAGATTCATGTCAA | |
| | ASASGAPSTGGTSESAT | | GGAGATAGTGGGGGACCCCATGT | |
| | PESGPGSPAGSPTSTEE | | TACTGAAGTGGAAGGGACCAGTT | |
| | GSPAGSPTSTEEGSTSST | | TCTTAACTGGAATTATTAGCTGG | |
| | AESPGPGSTSESPSGTAP | | GGTGAAGAGTGTGCAATGAAAG | |
| | GTSPSGESSTAPGTPGS | | GCAAATATGGAATATATACCAAG | |
| | GTASSSPGSSTPSGATG | | GTATCCCGGTATGTCAACTGGAT | |
| | SPGSSPSASTGTGPGSEP | | TAAGGAAAAAACAAAGCTCACT | |
| | ATSGSETPGTSESATPES | | GGAGGTACTTCTACTGAACCGTC | |
| | GPGSEPATSGSETPGST | | TGAAGGCAGCGCACCAGGTAGC | |
| | SSTAESPGPGSTSSTAES | | GAACCGGCTACTTCCGGTTCTGA | |
| | PGPGTSPSGESSTAPGSE | | AACCCCAGGTAGCCCAGCAGGTT | |
| | PATSGSETPGSEPATSG | | CTCCAACTTCTACTGAAGAAGGT | |
| | SETPGTSTEPSEGSAPGS | | TCTACCAGCTCTACCGCAGAATC | |
| | TSSTAESPGPGTSTPESG | | TCCTGGTCCAGGTACCTCTACTCC | |
| | SASPGSTSESPSGTAPGT | | GGAAAGCGGCTCTGCATCTCCAG | |
| | STEPSEGSAPGTSTEPSE | | GTTCTACTAGCGAATCTCCTTCTG | |
| | GSAPGTSTEPSEGSAPG | | GCACTGCACCAGGTTCTACTAGC | |
| | SSTPSGATGSPGSSPSAS | | GAATCCCCGTCTGGTACTGCTCC | |
| | TGTGPGASPGTSSTGSP | | AGGTACTTCTACTCCTGAAAGCG | |
| | GSEPATSGSETPGTSES | | GTTCCGCTTCTCCAGGTACCTCTA | |
| | ATPESGPGSPAGSPTST | | CTCCGGAAAGCGGTTCTGCATCT | |
| | EEGSSTPSGATGSPGSSP | | CCAGGTAGCGAACCGGCAACCTC | |
| | SASTGTGPGASPGTSST | | CGGCTCTGAAACCCCAGGTACCT | |
| | GSPGTSESATPESGPGT | | CTGAAAGCGCTACTCCTGAATCC | |
| | STEPSEGSAPGTSTEPSE | | GGCCCAGGTAGCCCGGCAGGTTC | |
| | GSAPG | | TCCGACTTCCACTGAGGAAGGTA | |
| | | | CCTCTACTGAACCTTCTGAGGGC | |
| | | | AGCGCTCCAGGTACTTCTGAAAG | |
| | | | CGCTACCCCGGAGTCCGGTCCAG | |
| | | | GTACTTCTACTGAACCGTCCGAA | |
| | | | GGTAGCGCACCAGGTACTTCTAC | |
| | | | CGAACCGTCCGAGGGTAGCGCAC | |
| | | | CAGGTAGCCCAGCAGGTTCTCCT | |
| | | | ACCTCCACCGAGGAAGGTACTTC | |
| | | | TACCGAACCGTCCGAGGGTAGCG | |
| | | | CACCAGGTACTTCTACCGAACCT | |
| | | | TCCGAGGGCAGCGCACCAGGTAC | |
| | | | TTCTGAAAGCGCTACCCCTGAGT | |
| | | | CCGGCCCAGGTACTTCTGAAAGC | |
| | | | GCTACTCCTGAATCCGGTCCAGG | |
| | | | TACCTCTACTGAACCTTCCGAAG | |
| | | | GCAGCGCTCCAGGTACCTCTACC | |
| | | | GAACCGTCCGAGGGCAGCGCACC | |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | | | AGGTACTTCTGAAAGCGCAACCC<br>CTGAATCCGGTCCAGGTACTTCT<br>ACTGAACCTTCCGAAGGTAGCGC<br>TCCAGGTAGCGAACCTGCTACTT<br>CTGGTTCTGAAACCCAGGTAGC<br>CCGGCTGGCTCTCCGACCTCCAC<br>CGAGGAAGGTAGCTCTACCCCGT<br>CTGGTGCTACTGGTTCTCCAGGT<br>ACTCCGGGCAGCGGTACTGCTTC<br>TTCCTCTCCAGGTAGCTCTACCCC<br>TTCTGGTGCTACTGGCTCTCCAG<br>GTACCTCTACCGAACCGTCCGAG<br>GGTAGCGCACCAGGTACCTCTAC<br>TGAACCGTCTGAGGGTAGCGCTC<br>CAGGTAGCGAACCGGCAACCTCC<br>GGTTCTGAAACTCCAGGTAGCCC<br>TGCTGGCTCTCCGACTTCTACTGA<br>GGAAGGTAGCCCGGCTGGTTCTC<br>CGACTTCTACTGAGGAAGGTACT<br>TCTACCGAACCTTCCGAAGGTAG<br>CGCTCCAGGTGCAAGCGCAAGCG<br>GCGCGCCAAGCACGGGAGGTACT<br>TCTGAAAGCGCTACTCCTGAGTC<br>CGGCCCAGGTAGCCCGGCTGGCT<br>CTCCGACTTCCACCGAGGAAGGT<br>AGCCCGGCTGGCTCTCCAACTTC<br>TACTGAAGAAGGTTCTACCAGCT<br>CTACCGCTGAATCTCCTGGCCCA<br>GGTTCTACTAGCGAATCTCCGTC<br>TGGCACCGCACCAGGTACTTCCC<br>CTAGCGGTGAATCTTCTACTGCA<br>CCAGGTACCCCTGGCAGCGGTAC<br>CGCTTCTTCCTCTCCAGGTAGCTC<br>TACCCCGTCTGGTGCTACTGGCT<br>CTCCAGGTTCTAGCCCGTCTGCA<br>TCTACCGGTACCGGCCCAGGTAG<br>CGAACCGGCAACCTCCGGCTCTG<br>AAACTCCAGGTACTTCTGAAAGC<br>GCTACTCCGGAATCCGGCCCAGG<br>TAGCGAACCGGCTACTTCCGGCT<br>CTGAAACCCCAGGTTCCACCAGC<br>TCTACTGCAGAATCTCCGGGCCC<br>AGGTTCTACTAGCTCTACTGCAG<br>AATCTCCGGGTCCAGGTACTTCT<br>CCTAGCGGCGAATCTTCTACCGC<br>TCCAGGTAGCGAACCGGCAACCT<br>CTGGCTCTGAAACTCCAGGTAGC<br>GAACCTGCAACCTCCGGCTCTGA<br>AACCCCAGGTACTTCTACTGAAC<br>CTTCTGAGGGCAGCGCACCAGGT<br>TCTACCAGCTCTACCGCAGAATC<br>TCCTGGTCCAGGTACCTCTACTCC<br>GGAAAGCGGCTCTGCATCTCCAG<br>GTTCTACTAGCGAATCTCCTTCTG<br>GCACTGCACCAGGTACTTCTACC<br>GAACCGTCCGAAGGCAGCGCTCC<br>AGGTACCTCTACTGAACCTTCCG<br>AGGGCAGCGCTCCAGGTACCTCT<br>ACCGAACCTTCTGAAGGTAGCGC<br>ACCAGGTAGCTCTACTCCGTCTG<br>GTGCAACCGGCTCCCAGGTTCT<br>AGCCCGTCTGCTTCCACTGGTAC<br>TGGCCCAGGTGCTTCCCCGGGCA<br>CCAGCTCTACTGGTTCTCCAGGT<br>AGCGAACCTGCTACCTCCGGTTC<br>TGAAACCCCAGGTACCTCTGAAA<br>GCGCAACTCCGGAGTCTGGTCCA<br>GGTAGCCCTGCAGGTTCTCCTAC<br>CTCCACTGAGGAAGGTAGCTCTA<br>CTCCGTCTGGTGCAACCGGCTCC<br>CCAGGTTCTAGCCCGTCTGCTTCC<br>ACTGGTACTGGCCCAGGTGCTTC<br>CCCGGGCACCAGCTCTACTGGTT<br>CTCCAGGTACCTCTGAAAGCGCT | |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | | | ACTCCGGAGTCTGGCCCAGGTAC<br>CTCTACTGAACCGTCTGAGGGTA<br>GCGCTCCAGGTACTTCTACTGAA<br>CCGTCCGAAGGTAGCGCACCAGG<br>TTAA | |
| FIX-<br>XTEN_AE864,<br>pCW0563 | MQRVNMIMAESPGLITI<br>CLLGYLLSAECTVFLDH<br>ENANKILNRPKRYNSG<br>KLEEFVQGNLERECME<br>EKCSFEEAREVFENTER<br>TTEFWKQYVDGDQCES<br>NPCLNGGSCKDDINSYE<br>CWCPFGFEGKNCELDV<br>TCNIKNGRCEQFCKNS<br>ADNKVVCSCTEGYRLA<br>ENQKSCEPAVPFPCGRV<br>SVSQTSKLTRAETVFPD<br>VDYVNSTEAETILDNIT<br>QSTQSFNDFTRVVGGE<br>DAKPGQFPWQVVLNG<br>KVDAFCGGSIVNEKWI<br>VTAAHCVETGVKITVV<br>AGEHNIEETEHTEQKRN<br>VIRIIPHHNYNAAINKY<br>NHDIALLELDEPLVLNS<br>YVTPICIADKEYTNIFLK<br>FGSGYVSGWGRVFHKG<br>RSALVLQYLRVPLVDR<br>ATCLRSTKFTIYNNMFC<br>AGFHEGGRDSCQGDSG<br>GPHVTEVEGTSFLTGIIS<br>WGEECAMKGKYGIYT<br>KVSRYVNWIKEKTKLT<br>GGSPAGSPTSTEEGTSE<br>SATPESGPGTSTEPSEGS<br>APGSPAGSPTSTEEGTS<br>TEPSEGSAPGTSTEPSEG<br>SAPGTSESATPESGPGS<br>EPATSGSETPGSEPATS<br>GSETPGSPAGSPTSTEE<br>GTSESATPESGPGTSTEP<br>SEGSAPGTSTEPSEGSA<br>PGSPAGSPTSTEEGTSTE<br>PSEGSAPGTSTEPSEGS<br>APGTSESATPESGPGTS<br>TEPSEGSAPGTSESATPE<br>SGPGSEPATSGSETPGT<br>STEPSEGSAPGTSTEPSE<br>GSAPGTSESATPESGPG<br>TSESATPESGPGSPAGSP<br>TSTEEGTSESATPESGP<br>GSEPATSGSETPGTSES<br>ATPESGPGTSTEPSEGS<br>APGTSTEPSEGSAPGTS<br>TEPSEGSAPGTSTEPSEG<br>SAPGTSTEPSEGSAPGT<br>STEPSEGSAPGSPAGSPT<br>STEEGTSTEPSEGSAPG<br>TSESATPESGPGSEPATS<br>GSETPGTSESATPESGP<br>GSEPATSGSETPGTSES<br>ATPESGPGTSTEPSEGS<br>APGTSESATPESGPGSP<br>AGSPTSTEEGSPAGSPT<br>STEEGSPAGSPTSTEEG<br>TSESATPESGPGTSTEPS<br>EGSAPGTSESATPESGP<br>GSEPATSGSETPGTSES<br>ATPESGPGSEPATSGSE<br>TPGTSESATPESGPGTST<br>EPSEGSAPGSPAGSPTST<br>EEGTSESATPESGPGSEP<br>ATSGSETPGTSESATPES | 604 | ATGCAGCGCGTGAACATGATCAT<br>GGCAGAATCACCAGGCCTCATCA<br>CCATCTGCCTTTTAGGATATCTAC<br>TCAGTGCTGAATGTACAGTTTTTC<br>TTGATCATGAAAACGCCAACAAA<br>ATTCTGAATCGGCCAAAGAGGTA<br>TAATTCAGGTAAATTGGAAGAGT<br>TGTTCAAGGGAACCTTGAGAGA<br>GAATGTATGGAAGAAAAGTGTA<br>GTTTTGAAGAAGCACGAGAAGTT<br>TTTGAAAACACTGAAAGAACAAC<br>TGAATTTTGGAAGCAGTATGTTG<br>ATGGAGATCAGTGTGAGTCCAAT<br>CCATGTTTAAATGGCGGCAGTTG<br>CAAGGATGACATTAATTCCTATG<br>AATGTTGGTGTCCCTTTGGATTTG<br>AAGGAAAGAACTGTGAATTAGAT<br>GTAACATGTAACATTAAGAATGG<br>CAGATGCGAGCAGTTTTGTAAAA<br>ATAGTGCTGATAACAAGGTGGTT<br>TGCTCCTGTACTGAGGGATATCG<br>ACTTGCAGAAAACCAGAAGTCCT<br>GTGAACCAGCAGTGCCATTTCCA<br>TGTGGAAGAGTTTCTGTTTCACA<br>AACTTCTAAGCTCACCCGTGCTG<br>AGACTGTTTTTCCTGATGTGGACT<br>ATGTAAATTCTACTGAAGCTGAA<br>ACCATTTTGGATAACATCACTCA<br>AAGCACCCAATCATTTAATGACT<br>TCACTCGGGTTGTTGGTGGAGAA<br>GATGCCAAACCAGGTCAATTCCC<br>TTGGCAGGTTGTTTTGAATGGTA<br>AAGTTGATGCATTCTGTGGAGGC<br>TCTATCGTTAATGAAAAATGGAT<br>TGTAACTGCTGCCCACTGTGTTG<br>AAACTGGTGTTAAAATTACAGTT<br>GTCGCAGGTGAACATAATATTGA<br>GGAGACAGAACATACAGAGCAA<br>AAGCGAAATGTGATTCGAATTAT<br>TCCTCACCACAACTACAATGCAG<br>CTATTAATAAGTACAACCATGAC<br>ATTGCCCTTCTGGAACTGGACGA<br>ACCCTTAGTGCTAAACAGCTACG<br>TTACACCTATTTGCATTGCTGACA<br>AGGAATACACGAACATCTTCCTC<br>AAATTTGGATCTGGCTATGTAAG<br>TGGCTGGGGAAGAGTCTTCCACA<br>AAGGGAGATCAGCTTTAGTTCTT<br>CAGTACCTTAGAGTTCCACTTGTT<br>GACCGGAGCCACATGTCTTCGATC<br>TACAAAGTTCACCATCTATAACA<br>ACATGTTCTGTGCTGGCTTCCATG<br>AAGGAGGTAGAGATTCATGTCAA<br>GGAGATAGTGGGGGACCCCATGT<br>TACTGAAGTGGAAGGGACCAGTT<br>TCTTAACTGGAATTATTAGCTGG<br>GGTGAAGAGTGTGCAATGAAAG<br>GCAAATATGGAATATATACCAAG<br>GTATCCCGGTATGTCAACTGGAT<br>TAAGGAAAAAACAAAGCTCACT<br>GGAGGTAGCCCGGCTGGCTCTCC<br>TACCTCTACTGAGGAAGGTACTT<br>CTGAAAGCGCTACTCCTGAGTCT<br>GGTCCAGGTACCTCTACTGAACC<br>GTCCGAAGGTAGCGCTCCAGGTA<br>GCCCAGCAGGCTCTCCGACTTCC<br>ACTGAGGAAGGTACTTCTACTGA<br>ACCTTCCGAAGGCAGCGCACCAG | 605 |

TABLE 24-continued

FIX amino acid and nucleic acid sequences

| Name | Amino Acid Sequence | SEQ ID NO: | Nucleic Acid Sequences | SEQ ID NO: |
|------|---------------------|------------|------------------------|------------|
| | GPGSPAGSPTSTEEGSP<br>AGSPTSTEEGTSTEPSE<br>GSAPGTSESATPESGPG<br>TSESATPESGPGTSESAT<br>PESGPGSEPATSGSETP<br>GSEPATSGSETPGSPAG<br>SPTSTEEGTSTEPSEGSA<br>PGTSTEPSEGSAPGSEP<br>ATSGSETPGTSESATPES<br>GPGTSTEPSEGSAPG | | GTACCTCTACTGAACCTTCTGAG<br>GGCAGCGCTCCAGGTACTTCTGA<br>AAGCGCTACCCCGGAATCTGGCC<br>CAGGTAGCGAACCGGCTACTTCT<br>GGTTCTGAAACCCCAGGTAGCGA<br>ACCGGCTACCTCCGGTTCTGAAA<br>CTCCAGGTAGCCCGGCAGGCTCT<br>CCGACCTCTACTGAGGAAGGTAC<br>TTCTGAAAGCGCAACCCCGGAGT<br>CCGGCCCAGGTACCTCTACCGAA<br>CCGTCTGAGGGCAGCGCACCAGG<br>TACTTCTACCGAACCGTCCGAGG<br>GTAGCGCACCAGGTAGCCCAGCA<br>GGTTCTCCTACCTCCACCGAGGA<br>AGGTACTTCTACCGAACCGTCCG<br>AGGGTAGCGCACCAGGTACCTCT<br>ACTGAACCTTCTGAGGGCAGCGC<br>TCCAGGTACTTCTGAAAGCGCTA<br>CCCCGGAGTCCGGTCCAGGTACT<br>TCTACTGAACCGTCCGAAGGTAG<br>CGCACCAGGTACTTCTGAAAGCG<br>CAACCCCTGAATCCGGTCCAGGT<br>AGCGAACCGGCTACTTCTGGCTC<br>TGAGACTCCAGGTACTTCTACCG<br>AACCGTCCGAAGGTAGCGCACCA<br>GGTACTTCTACTGAACCGTCTGA<br>AGGTAGCGCACCAGGTACTTCTG<br>AAAGCGCAACCCCGGAATCCGGC<br>CCAGGTACCTCTGAAAGCGCAAC<br>CCCGGAGTCCGGCCCAGGTAGCC<br>CTGCTGGCTCTCCAACCTCCACC<br>GAAGAAGGTACCTCTGAAAGCGC<br>AACCCCTGAATCCGGCCCAGGTA<br>GCGAACCGGCAACCTCCGGTTCT<br>GAAACCCCAGGTACCTCTGAAAG<br>CGCTACTCCGGAGTCTGGCCCAG<br>GTACCTCTACTGAACCGTCTGAG<br>GGTAGCGCTCCAGGTACTTCTAC<br>TGAACCGTCCGAAGGTAGCGCAC<br>CAGGTACTTCTACCGAACCGTCC<br>GAAGGCAGCGCTCCAGGTACCTC<br>TACTGAACCTTCCGAGGGCAGCG<br>CTCCAGGTACCTCTACCGAACCT<br>TCTGAAGGTAGCGCACCAGGTAC<br>TTCTACCGAACCGTCCGAGGGTA<br>GCGCACCAGGTAGCCCAGCAGGT<br>TCTCCTACCTCCACCGAGGAAGG<br>TACTTCTACCGAACCGTCCGAGG<br>GTAGCGCACCAGGTACCTCTGAA<br>AGCGCAACTCCTGAGTCTGGCCC<br>AGGTAGCGAACCTGCTACCTCCG<br>GCTCTGAGACTCCAGGTACCTCT<br>GAAAGCGCAACCCCGGAATCTGG<br>TCCAGGTAGCGAACCTGCAACCT<br>CTGGCTCTGAAACCCCAGGTACC<br>TCTGAAAGCGCTACTCCTGAATC<br>TGGCCCAGGTACTTCTACTGAAC<br>CGTCCGAGGGCAGCGCACCAGGT<br>ACTTCTGAAAGCGCTACTCCTGA<br>GTCCGGCCCAGGTAGCCCGGCTG<br>GCTCTCCGACTTCCACCGAGGAA<br>GGTAGCCCGGCTGGCTCTCCAAC<br>TTCTACTGAAGAAGGTAGCCCGG<br>CAGGCTCTCCGACCTCTACTGAG<br>GAAGGTACTTCTGAAAGCGCAAC<br>CCCGGAGTCCGGCCCAGGTACCT<br>CTACCGAACCGTCTGAGGGCAGC<br>GCACCAGGTACCTCTGAAAGCGC<br>AACTCCTGAGTCTGGCCCAGGTA<br>GCGAACCTGCTACCTCCGGCTCT<br>GAGACTCCAGGTACCTCTGAAAG<br>CGCAACCCCGGAATCTGGTCCAG<br>GTAGCGAACCTGCAACCTCTGGC<br>TCTGAAACCCCAGGTACCTCTGA | |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | | | AAGCGCTACTCCTGAATCTGGCC CAGGTACTTCTACTGAACCGTCC GAGGGCAGCGCACCAGGTAGCC CTGCTGGCTCTCCAACCTCCACC GAAGAAGGTACCTCTGAAAGCGC AACCCCTGAATCCGGCCCAGGTA GCGAACCGGCAACCTCCGGTTCT GAAACCCCAGGTACTTCTGAAAG CGCTACTCCTGAGTCCGGCCCAG GTAGCCCGGCTGGCTCTCCGACT TCCACCGAGGAAGGTAGCCCGGC TGGCTCTCCAACTTCTACTGAAG AAGGTACTTCTACCGAACCTTCC GAGGGCAGCGCACCAGGTACTTC TGAAAGCGCTACCCCTGAGTCCG GCCCAGGTACTTCTGAAAGCGCT ACTCCTGAATCCGGTCCAGGTAC TTCTGAAAGCGCTACCCCGGAAT CTGGCCCAGGTAGCGAACCGGCT ACTTCTGGTTCTGAAACCCCAGG TAGCGAACCGGCTACCTCCGGTT CTGAAACTCCAGGTAGCCCAGCA GGCTCTCCGACTTCCACTGAGGA AGGTACTTCTACTGAACCTTCCG AAGGCAGCGCACCAGGTACCTCT ACTGAACCTTCTGAGGGCAGCGC TCCAGGTAGCGAACCTGCAACCT CTGGCTCTGAAACCCCAGGTACC TCTGAAAGCGCTACTCCTGAATC TGGCCCAGGTACTTCTACTGAAC CGTCCGAGGGCAGCGCACCAGGT TAA | |
| FIX-XTEN_AF864, pCW0564 | MQRVNMIMAESPGLITI CLLGYLLSAECTVFLDH ENANKILNRPKRYNSG KLEEFVQGNLERECME EKCSFEEAREVFENTER TTEFWKQYVDGDQCES NPCLNGGSCKDDINSYE CWCPFGFEGKNCELDV TCNIKNGRCEQFCKNS ADNKVVCSCTEGYRLA ENQKSCEPAVPFPCGRV SVSQTSKLTRAETVFPD VDYVNSTEAETILDNIT QSTQSFNDFTRVVGGE DAKPGQFPWQVVLNG KVDAFCGGSIVNEKWI VTAAHCVETGVKITVV AGEHNIEETEHTEQKRN VIRIIPHHNYNAAINKY NHDIALLELDEPLVLNS YVTPICIADKEYTNIFLK FGSGYVSGWGRVFHKG RSALVLQYLRVPLVDR ATCLRSTKFTIYNNMFC AGFHEGGRDSCQGDSG GPHVTEVEGTSFLTGIIS WGEECAMKGKYGIYT KVSRYVNWIKEKTKLT GGSTSESPSGTAPGTSPS GESSTAPGSTSESPSGT APGSTSESPSGTAPGTS TPESGSASPGTSTPESGS ASPGSTSESPSGTAPGST SESPSGTAPGTSPSGESS TAPGSTSESPSGTAPGT SPSGESSTAPGTSPSGES STAPGSTSSTAESPGPG TSPSGESSTAPGTSPSGE SSTAPGSTSSTAESPGPG TSTPESGSASPGTSTPES GSASPGSTSESPSGTAP | 606 | ATGCAGCGCGTGAACATGATCAT GGCAGAATCACCAGGCCTCATCA CCATCTGCCTTTTAGGATATCTAC TCAGTGCTGAATGTACAGTTTTTC TTGATCATGAAAACGCCAACAAA ATTCTGAATCGGCCAAAGAGGTA TAATTCAGGTAAATTGGAAGAGT TTGTTCAAGGGAACCTTGAGAGA GAATGTATGGAAGAAAGTGTA GTTTTGAAGAAGCACGAGAAGTT TTTGAAAACACTGAAAGAACAAC TGAATTTTGGAAGCAGTATGTTG ATGGAGATCAGTGTGAGTCCAAT CCATGTTTAAATGGCGGCAGTTG CAAGGATGACATTAATTCCTATG AATGTTGGTGTCCCTTTGGATTTG AAGGAAAGAACTGTGAATTAGAT GTAACATGTAACATTAAGAATGG CAGATGCGAGCAGTTTTGTAAAA ATAGTGCTGATAACAAGGTGGTT TGCTCCTGTACTGAGGGATATCG ACTTGCAGAAACCAGAAGTCCT GTGAACCAGCAGTGCCATTTCCA TGTGGAAGAGTTTCTGTTTCACA AACTTCTAAGCTCACCCGTGCTG AGACTGTTTTTCCTGATGTGGACT ATGTAAATTCTACTGAAGCTGAA ACCATTTTGGATAACATCACTCA AAGCACCCAATCATTTAATGACT TCACTCGGGTTGTTGGTGGAGAA GATGCCAAACCAGGTCAATTCCC TTGGCAGGTTGTTTTGAATGGTA AAGTTGATGCATTCTGTGGAGGC TCTATCGTTAATGAAAAATGGAT TGTAACTGCTGCCCACTGTGTTG AAACTGGTGTTAAAATTACAGTT GTCGCAGGTGAACATAATATTGA GGAGACAGAACATACAGAGCAA AAGCGAAATGTGATTCGAATTAT TCCTCACCACAACTACAATGCAG CTATTAATAAGTACAACCATGAC | 607 |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | GSTSESPSGTAPGTSTPE SGSASPGSTSSTAESPGP GTSTPESGSASPGSTSES PSGTAPGTSPSGESSTAP GSTSSTAESPGPGTSPSG ESSTAPGTSTPESGSASP GSTSSTAESPGPGTSSST AESPGPGSTSSTAESPGP GSTSSTAESPGPGTSPSG ESSTAPGSTSESPSGTAP GSTSESPSGTAPGTSTPE SGPGGGGASASGAPST GGGGSESPSGTAPGSTS ESPSGTAPGSTSESPSGT APGSTSESPSGTAPGSTS ESPSGTAPGSTSESPSGT APGTSTPESGSASPGTSP SGESSTAPGTSPSGESST APGSTSSTAESPGPGTSP SGESSTAPGTSTPESGS ASPGSTSESPSGTAPGST SESPSGTAPGTSPSGESS TAPGSTSESPSGTAPGT STPESGSASPGTSTPESG SASPGSTSESPSGTAPGT STPESGSASPGSTSSTAE SPGPGSTSESPSGTAPGS TSESPSGTAPGTSPSGES STAPGSTSSTAESPGPG TSPSGESSTAPGTSTPES GSASPGTSPSGESSTAP GTSPSGESSTAPGTSPSG ESSTAPGSTSSTAESPGP GSTSSTAESPGPGTSPSG ESSTAPGSSPSASTGTGP GSSTPSGATGSPGSSTPS GATGSPG | | ATTGCCCTTCTGGAACTGGACGA ACCCTTAGTGCTAAACAGCTACG TTACACCTATTTGCATTGCTGACA AGGAATACACGAACATCTTCCTC AAATTTGGATCTGGCTATGTAAG TGGCTGGGGAAGAGTCTTCCACA AAGGGAGATCAGCTTTAGTTCTT CAGTACCTTAGAGTTCCACTTGTT GACCGAGCCACATGTCTTCGATC TACAAAGTTCACCATCTATAACA ACATGTTCTGTGCTGGCTTCCATG AAGGAGGTAGAGATTCATGTCAA GGAGATAGTGGGGGACCCCATGT TACTGAAGTGGAAGGGACCAGTT TCTTAACTGGAATTATTAGCTGG GGTGAAGAGTGTGCAATGAAAG GCAAATATGGAATATATACCAAG GTATCCCGGTATGTCAACTGGAT TAAGGAAAAACAAAGCTCACT GGAGGTTCTACCAGCGAATCTCC TTCTGGCACCGCTCCAGGTACCT CTCCTAGCGGCGAATCTTCTACC GCTCCAGGTTCTACTAGCGAATC TCCTTCTGGCACTGCACCAGGTT CTACTAGCGAATCCCGTCTGGT ACTGCTCCAGGTACTTCTACTCCT GAAAGCGGTTCCGCTTCTCCAGG TACCTCTACTCCGGAAAGCGGTT CTGCATCTCCAGGTTCTACCAGC GAATCCCTTCTGGCACCGCTCC AGGTTCTACTAGCGAATCCCGT CTGGTACCGCACCAGGTACTTCT CCTAGCGGCGAATCTTCTACCGC ACCAGGTTCTACTAGCGAATCTC CGTCTGGCACTGCTCCAGGTACT TCTCCTAGCGGTGAATCTTCTACC GCTCCAGGTACTTCCCCTAGCGG CGAATCTTCTACCGCTCCAGGTT CTACTAGCTCTACTGCAGAATCT CCGGGCCCAGGTACCTCTCCTAG CGGTGAATCTTCTACCGCTCCAG GTACTTCTCCGAGCGGTGAATCT TCTACCGCTCCAGGTTCTACTAG CTCTACTGCAGAATCTCCTGGCC CAGGTACCTCTACTCCGGAAAGC GGCTCTGCATCTCCAGGTACTTCT ACCCCTGAAAGCGGTTCTGCATC TCCAGGTTCTACTAGCGAATCTC CTTCTGGCACTGCACCAGGTTCT ACCAGCGAATCTCCGTCTGGCAC TGCACCAGGTACCTCTACCCCTG AAAGCGGTTCCGCTTCTCCAGGT TCTACCAGCTCTACCGCAGAATC TCCTGGTCCAGGTACCTCTACTCC GGAAAGCGGCTCTGCATCTCCAG GTTCTACTAGCGAATCTCCTTCTG GCACTGCACCAGGTACTTCTCCG AGCGGTGAATCTTCTACCGCACC AGGTTCTACTAGCTCTACCGCTG AATCTCCGGGCCCAGGTACTTCT CCGAGCGGTGAATCTTCTACTGC TCCAGGTACCTCTACTCCTGAAA GCGGTTCTGCATCTCCAGGTTCC ACTAGCTCTACCGCAGAATCTCC GGGCCCAGGTTCTACTAGCTCTA CTGCTGAATCTCCTGGCCCAGGT TCTACTAGCTCTACTGCTGAATCT CCGGGTCCAGGTTCTACCAGCTC TACTGCTGAATCTCCTGGTCCAG GTACCTCCCCGAGCGGTGAATCT TCTACTGCACCAGGTTCTACTAG CGAATCTCCTTCTGGCACTGCAC CAGGTTCTACCAGCGAATCTCCG TCTGGCACTGCACCAGGTACCTC | |

| Name | Amino Acid Sequence | SEQ ID NO: | Nucleic Acid Sequences | SEQ ID NO: |
|---|---|---|---|---|
| | | | TACCCCTGAAAGCGGTCCGGGGG<br>GGGGGGGTGCAAGCGCAAGCGG<br>CGCGCCAAGCACGGGAGGGGGG<br>GGTAGCGAATCTCCTTCTGGTAC<br>CGCTCCAGGTTCTACCAGCGAAT<br>CCCCGTCTGGTACTGCTCCAGGT<br>TCTACCAGCGAATCTCCTTCTGGT<br>ACTGCACCAGGTTCTACTAGCGA<br>ATCTCCTTCTGGTACCGCTCCAG<br>GTTCTACCAGCGAATCCCCGTCT<br>GGTACTGCTCCAGGTTCTACCAG<br>CGAATCTCCTTCTGGTACTGCAC<br>CAGGTACTTCTACTCCGGAAAGC<br>GGTTCCGCATCTCCAGGTACTTCT<br>CCTAGCGGTGAATCTTCTACTGC<br>TCCAGGTACCTCTCCTAGCGGCG<br>AATCTTCTACTGCTCCAGGTTCTA<br>CCAGCTCTACTGCTGAATCTCCG<br>GGTCCAGGTACTTCCCCGAGCGG<br>TGAATCTTCTACTGCACCAGGTA<br>CTTCTACTCCGGAAAGCGGTTCC<br>GCTTCTCCAGGTTCTACCAGCGA<br>ATCTCCTTCTGGCACCGCTCCAG<br>GTTCTACTAGCGAATCCCCGTCT<br>GGTACCGCACCAGGTACTTCTCC<br>TAGCGGCGAATCTTCTACCGCAC<br>CAGGTTCTACTAGCGAATCCCG<br>TCTGGTACCGCACCAGGTACTTC<br>TACCCCGGAAAGCGGCTCTGCTT<br>CTCCAGGTACTTCTACCCCGGAA<br>AGCGGCTCCGCATCTCCAGGTTC<br>TACTAGCGAATCTCCTTCTGGTA<br>CCGCTCCAGGTACTTCTACCCCT<br>GAAAGCGGCTCCGCTTCTCCAGG<br>TTCCACTAGCTCTACCGCTGAAT<br>CTCCGGGTCCAGGTTCTACCAGC<br>GAATCTCCTTCTGGCACCGCTCC<br>AGGTTCTACTAGCGAATCCCCGT<br>CTGGTACCGCACCAGGTACTTCT<br>CCTAGCGGCGAATCTTCTACCGC<br>ACCAGGTTCTACCAGCTCTACTG<br>CTGAATCTCCGGGTCCAGGTACT<br>TCCCCGAGCGGTGAATCTTCTAC<br>TGCACCAGGTACTTCTACTCCGG<br>AAAGCGGTTCCGCTTCTCCAGGT<br>ACCTCCCCTAGCGGCGAATCTTC<br>TACTGCTCCAGGTACCTCTCCTA<br>GCGGCGAATCTTCTACCGCTCCA<br>GGTACCTCCCCTAGCGGTGAATC<br>TTCTACCGCACCAGGTTCTACTA<br>GCTCTACTGCTGAATCTCCGGGT<br>CCAGGTTCTACCAGCTCTACTGC<br>TGAATCTCCTGGTCCAGGTACCT<br>CCCCGAGCGGTGAATCTTCTACT<br>GCACCAGGTTCTAGCCCTTCTGC<br>TTCCACCGGTACCGGCCCAGGTA<br>GCTCTACTCCGTCTGGTGCAACT<br>GGCTCTCCAGGTAGCTCTACTCC<br>GTCTGGTGCAACCGGCTCCCCAG<br>GTTAA | |
| FIX-<br>XTEN_AG864,<br>pCW0565 | MQRVNMIMAESPGLITI<br>CLLGYLLSAECTVFLDH<br>ENANKILNRPKRYNSG<br>KLEEFVQGNLERECME<br>EKCSFEEAREVFENTER<br>TTEFWKQYVDGDQCES<br>NPCLNGGSCKDDINSYE<br>CWCPFGFEGKNCELDV<br>TCNIKNGRCEQFCKNS<br>ADNKVVCSCTEGYRLA<br>ENQKSCEPAVPFPCGRV<br>SVSQTSKLTRAETVFPD<br>VDYVNSTEAETILDNIT | 608 | ATGCAGCGCGTGAACATGATCAT<br>GGCAGAATCACCAGGCCTCATCA<br>CCATCTGCCTTTTAGGATATCTAC<br>TCAGTGCTGAATGTACAGTTTTTC<br>TTGATCATGAAAACGCCAACAAA<br>ATTCTGAATCGGCCAAAGAGGTA<br>TAATTCAGGTAAATTGGAAGAGT<br>TTGTTCAAGGGAACCTTGAGAGA<br>GAATGTATGGAAGAAAAGTGTA<br>GTTTTGAAGAAGCACGAGAAGTT<br>TTTGAAAACACTGAAGAACAAC<br>TGAATTTTGGAAGCAGTATGTTG<br>ATGGAGATCAGTGTGAGTCCAAT | 609 |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | QSTQSFNDFTRVVGGE | | CCATGTTTAAATGGCGGCAGTTG | |
| | DAKPGQFPWQVVLNG | | CAAGGATGACATTAATTCCTATG | |
| | KVDAFCGGSIVNEKWI | | AATGTTGGTGTCCCTTTGGATTTG | |
| | VTAAHCVETGVKITVV | | AAGGAAAGAACTGTGAATTAGAT | |
| | AGEHNIEETEHTEQKRN | | GTAACATGTAACATTAAGAATGG | |
| | VIRIIPHHNYNAAINKY | | CAGATGCGAGCAGTTTTGTAAAA | |
| | NHDIALLELDEPLVLNS | | ATAGTGCTGATAACAAGGTGGTT | |
| | YVTPICIADKEYTNIFLK | | TGCTCCTGTACTGAGGGATATCG | |
| | FGSGYVSGWGRVFHKG | | ACTTGCAGAAAACCAGAAGTCCT | |
| | RSALVLQYLRVPLVDR | | GTGAACCAGCAGTGCCATTTCCA | |
| | ATCLRSTKFTIYNNMFC | | TGTGGAAGAGTTTCTGTTTCACA | |
| | AGFHEGGRDSCQGDSG | | AACTTCTAAGCTCACCCGTGCTG | |
| | GPHVTEVEGTSFLTGIIS | | AGACTGTTTTCCTGATGTGGACT | |
| | WGEECAMKGKYGIYT | | ATGTAAATTCTACTGAAGCTGAA | |
| | KVSRYVNWIKEKTKLT | | ACCATTTTGGATAACATCACTCA | |
| | GGASPGTSSTGSPGSSP | | AAGCACCCAATCATTTAATGACT | |
| | SASTGTGPGSSPSASTG | | TCACTCGGGTTGTTGGTGGAGAA | |
| | TGPGTPGSGTASSSPGS | | GATGCCAAACCAGGTCAATTCCC | |
| | STPSGATGSPGSNPSAS | | TTGGCAGGTTGTTTTGAATGGTA | |
| | TGTGPGASPGTSSTGSP | | AAGTTGATGCATTCTGTGGAGGC | |
| | GTPGSGTASSSPGSSTPS | | TCTATCGTTAATGAAAAATGGAT | |
| | GATGSPGTPGSGTASSS | | TGTAACTGCTGCCCACTGTGTTG | |
| | PGASPGTSSTGSPGASP | | AAACTGGTGTTAAAATTACAGTT | |
| | GTSSTGSPGTPGSGTAS | | GTCGCAGGTGAACATAATATTGA | |
| | SSPGSSTPSGATGSPGA | | GGAGACAGAACATACAGAGCAA | |
| | SPGTSSTGSPGTPGSGT | | AAGCGAAATGTGATTCGAATTAT | |
| | ASSSPGSSTPSGATGSP | | TCCTCACCACAACTACAATGCAG | |
| | GSNPSASTGTGPGSSPS | | CTATTAATAAGTACAACCATGAC | |
| | ASTGTGPGSSTPSGATG | | ATTGCCCTTCTGGAACTGGACGA | |
| | SPGSSTPSGATGSPGAS | | ACCCTTAGTGCTAAACAGCTACG | |
| | PGTSSTGSPGASPGTSST | | TTACACCTATTTGCATTGCTGACA | |
| | GSPGASPGTSSTGSPGT | | AGGAATACACGAACATCTTCCTC | |
| | PGSGTASSSPGASPGTS | | AAATTTGGATCTGGCTATGTAAG | |
| | STGSPGASPGTSSTGSP | | TGGCTGGGGAAGAGTCTTCCACA | |
| | GASPGTSSTGSPGSSPS | | AAGGGAGATCAGCTTTAGTTCTT | |
| | ASTGTGPGTPGSGTASS | | CAGTACCTTAGAGTTCCACTTGTT | |
| | SPGASPGTSSTGSPGAS | | GACCGAGCCACATGTCTTCGATC | |
| | PGTSSTGSPGASPGTSST | | TACAAAGTTCACCATCTATAACA | |
| | GSPGSSTPSGATGSPGS | | ACATGTTCTGTGCTGGCTTCCATG | |
| | STPSGATGSPGASPGTS | | AAGGAGGTAGAGATTCATGTCAA | |
| | STGSPGTPGSGTASSSP | | GGAGATAGTGGGGGACCCCATGT | |
| | GSSTPSGATGSPGSSTPS | | TACTGAAGTGGAAGGGACCAGTT | |
| | GATGSPGSSTPSGATGS | | TCTTAACTGGAATTATTAGCTGG | |
| | PGSSPSASTGTGPGASP | | GGTGAAGAGTGTGCAATGAAAG | |
| | GTSSTGSPGASPGTSST | | GCAAATATGGAATATATACCAAG | |
| | GSPGTPGSGTASSSPGA | | GTATCCCGGTATGTCAACTGGAT | |
| | SPGTSSTGSPGASPGTSS | | TAAGGAAAAAACAAAGCTCACT | |
| | TGSPGASPGTSSTGSPG | | GGAGGTGCTTCCCCGGGCACCAG | |
| | ASPGTSSTGSPGTPGSG | | CTCTACTGGTTCTCCAGGTTCTAG | |
| | TASSSPGSSTPSGATGSP | | CCCGTCTGCTTCTACTGGTACTGG | |
| | GTPGSGTASSSPGSSTPS | | TCCAGGTTCTAGCCCTTCTGCTTC | |
| | GATGSPGTPGSGTASSS | | CACTGGTACTGGTCCAGGTACCC | |
| | PGSSTPSGATGSPGSSTP | | CGGGTAGCGGTACCGCTTCTTCT | |
| | SGATGSPGSSPSASTGT | | TCTCCAGGTAGCTCTACTCCGTCT | |
| | GPGSSPSASTGTGPGAS | | GGTGCTACCGGCTCTCCAGGTTC | |
| | PGTSSTGSPGTPGSGTA | | TAACCCTTCTGCATCCACCGGTA | |
| | SSSPGSSTPSGATGSPGS | | CCGGCCCAGGTGCTTCTCCGGGC | |
| | SPSASTGTGPGSSPSAST | | ACCAGCTCTACTGGTTCTCCAGG | |
| | GTGPGASPGTSSTGSPG | | TACCCCGGGCAGCGGTACCGCAT | |
| | ASPGTSSTGSPGSSTPSG | | CTTCTTCTCCAGGTAGCTCTACTC | |
| | ATGSPGSSPSASTGTGP | | CTTCTGGTGCAACTGGTTCTCCA | |
| | GASPGTSSTGSPGSSPS | | GGTACTCCTGGCAGCGGTACCGC | |
| | ASTGTGPGTPGSGTASS | | TTCTTCTTCTCCAGGTGCTTCTCC | |
| | SPGSSTPSGATGSPGSST | | TGGTACTAGCTCTACTGGTTCTCC | |
| | PSGATGSPGASPGTSST | | AGGTGCTTCTCCGGGCACTAGCT | |
| | GSPG | | CTACTGGTTCTCCAGGTACCCCG | |
| | | | GGTAGCGGTACTGCTTCTTCCTCT | |
| | | | CCAGGTAGCTCTACCCCTTCTGG | |
| | | | TGCAACCGGCTCTCCAGGTGCTT | |
| | | | CTCCGGGCACCAGCTCTACCGGT | |
| | | | TCTCCAGGTACCCCGGGTAGCGG | |
| | | | TACCGCTTCTTCTTCTCCAGGTAG | |
| | | | CTCTACTCCGTCTGGTGCTACCG | |
| | | | GCTCTCCAGGTTCTAACCCTTCTG | |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | | | CATCCACCGGTACCGGCCCAGGT<br>TCTAGCCCTTCTGCTTCCACCGGT<br>ACTGGCCCAGGTAGCTCTACCCC<br>TTCTGGTGCTACCGGCTCCCCAG<br>GTAGCTCTACTCCTTCTGGTGCA<br>ACTGGCTCTCCAGGTGCATCTCC<br>GGGCACTAGCTCTACTGGTTCTC<br>CAGGTGCATCCCCTGGCACTAGC<br>TCTACTGGTTCTCCAGGTGCTTCT<br>CCTGGTACCAGCTCTACTGGTTCT<br>CCAGGTACTCCTGGCAGCGGTAC<br>CGCTTCTTCTTCTCCAGGTGCTTC<br>TCCTGGTACTAGCTCTACTGGTTC<br>TCCAGGTGCTTCTCCGGGCACTA<br>GCTCTACTGGTTCTCCAGGTGCTT<br>CCCCGGGCACTAGCTCTACCGGT<br>TCTCCAGGTTCTAGCCCTTCTGCA<br>TCTACTGGTACTGGCCCAGGTAC<br>TCCGGGCAGCGGTACTGCTTCTT<br>CCTCTCCAGGTGCATCTCCGGGC<br>ACTAGCTCTACTGGTTCTCCAGG<br>TGCATCCCCTGGCACTAGCTCTA<br>CTGGTTCTCCAGGTGCTTCTCCTG<br>GTACCAGCTCTACTGGTTCTCCA<br>GGTAGCTCTACTCCGTCTGGTGC<br>AACCGGTTCCCCAGGTAGCTCTA<br>CTCCTTCTGGTGCTACTGGCTCCC<br>CAGGTGCATCCCCTGGCACCAGC<br>TCTACCGGTTCTCCAGGTACCCC<br>GGGCAGCGGTACCGCATCTTCCT<br>CTCCAGGTAGCTCTACCCCGTCT<br>GGTGCTACCGGTTCCCCAGGTAG<br>CTCTACCCCGTCTGGTGCAACCG<br>GCTCCCCAGGTAGCTCTACTCCG<br>TCTGGTGCAACCGGCTCCCCAGG<br>TTCTAGCCCGTCTGCTTCCACTGG<br>TACTGGCCCAGGTGCTTCCCCGG<br>GCACCAGCTCTACTGGTTCTCCA<br>GGTGCATCCCCGGGTACCAGCTC<br>TACCGGTTCTCCAGGTACTCCTG<br>GCAGCGGTACTGCATCTTCCTCT<br>CCAGGTGCTTCTCCGGGCACCAG<br>CTCTACTGGTTCTCCAGGTGCATC<br>TCCGGGCACTAGCTCTACTGGTT<br>CTCCAGGTGCATCCCCTGGCACT<br>AGCTCTACTGGTTCTCCAGGTGC<br>TTCTCCTGGTACCAGCTCTACTGG<br>TTCTCCAGGTACCCCTGGTAGCG<br>GTACTGCTTCTTCCTCTCCAGGTA<br>GCTCTACTCCGTCTGGTGCTACC<br>GGTTCTCCAGGTACCCCGGGTAG<br>CGGTACCGCATCTTCTTCTCCAG<br>GTAGCTCTACCCCGTCTGGTGCT<br>ACTGGTTCTCCAGGTACTCCGGG<br>CAGCGGTACTGCTTCTTCCTCTCC<br>AGGTAGCTCTACCCCTTCTGGTG<br>CTACTGGCTCTCCAGGTAGCTCT<br>ACCCCGTCTGGTGCTACTGGCTC<br>CCCAGGTTCTAGCCCTTCTGCATC<br>CACCGGTACCGGTCCAGGTTCTA<br>GCCCGTCTGCATCTACTGGTACT<br>GGTCCAGGTGCATCCCCGGGCAC<br>TAGCTCTACCGGTTCTCCAGGTA<br>CTCCTGGTAGCGGTACTGCTTCTT<br>CTTCTCCAGGTAGCTCTACTCCTT<br>CTGGTGCTACTGGTTCTCCAGGTT<br>CTAGCCCTTCTGCATCCACCGGT<br>ACCGGCCCAGGTTCTAGCCCGTC<br>TGCTTCTACCGGTACTGGTCCAG<br>GTGCTTCTCCGGGTACTAGCTCT<br>ACTGGTTCTCCAGGTGCATCTCCT<br>GGTACTAGCTCTACTGGTTCTCC<br>AGGTAGCTCTACTCCGTCTGGTG<br>CAACCGGCTCTCCAGGTTCTAGC | |

TABLE 24-continued

FIX amino acid and nucleic acid sequences

| Name | Amino Acid Sequence | SEQ ID NO: | Nucleic Acid Sequences | SEQ ID NO: |
|---|---|---|---|---|
| | | | CCTTCTGCATCTACCGGTACTGGT<br>CCAGGTGCATCCCCTGGTACCAG<br>CTCTACCGGTTCTCCAGGTTCTAG<br>CCCTTCTGCTTCTACCGGTACCGG<br>TCCAGGTACCCCTGGCAGCGGTA<br>CCGCATCTTCCTCTCCAGGTAGCT<br>CTACTCCGTCTGGTGCAACCGGT<br>TCCCCAGGTAGCTCTACTCCTTCT<br>GGTGCTACTGGCTCCCCAGGTGC<br>ATCCCCTGGCACCAGCTCTACCG<br>GTTCTCCAGGTTAA | |
| PC5, pBC0037, pBC0038 | MGWGSRCCCPGRLDLL CVLALLGGCLLPVCRT RVYTNHWAVKIAGGFP EANRIASKYGFINIGQIG ALKDYYHFYHSRTIKRS VISSRGTHSFISMEPKVE WIQQQVVKKRTKRDY DFSRAQSTYFNDPKWP SMWYMHCSDNTHPCQ SDMNIEGAWKRGYTG KNIVVTILDDGIERTHP DLMQNYDALASCDVN GNDLDPMPRYDASNEN KHGTRCAGEVAAAAN NSHCTVGIAFNAKIGGV RMLDGDVTDMVEAKS VSFNPQHVHIYSASWG PDDDGKTVDGPAPLTR QAFENGVRMGRRGLGS VFVWASGNGGRSKDH CSCDGYTNSIYTISISST AESGKKPWYLEECSST LATTYSSGESYDKKIITT DLRQRCTDNHTGTSAS APMAAGIIALALEANPF LTWRDVQHIVIVRTSRA GHLNANDWKTNAAGF KVSHLYGFGLMDAEA MVMEAEKWTTVPRQH VCVESTDRQIKTIRPNS AVRSIYKASGCSDNPNR HVNYLEHVVVRITITHP RRGDLAIYLTSPSGTRS QLLANRLFDHSMEGFK NWEFMTIHCWGERAA GDWVLEVYDTPSQLRN FKTPGKLKEWSLVLYG TSVQPYSPTNEFPKVER FRYSRVEDPTDDYGTE DYAGPCDPECSEVGCD GPGPDHCNDCLHYYK LKNNTRICVSSCPPGHY HADKKRCRKCAPNCES CFGSHGDQCMSCKYGY FLNEETNSCVTHCPDGS YQDTKKNLCRKCSENC KTCTEFHNCTECRDGLS LQGSRCSVSCEDGRYF NGQDCQPCHRFCATCA GAGADGCINCTEGYFM EDGRCVQSCSISYYFDH SSENGYKSCKKCDISCL TCNGPGFKNCTSCPSGY LLDLGMCQMGAICKDA TEESWAEGGFCMLVKK NNLCQRKVLQQLCCKT CTFQG | 610 | atgggctgggggagccgctgctgctgcccgggacgt ttggacctgctgtgcgtgctggcgctgctcgggggct gcctgctccccgtgtgtcggacgcgcgtctacaccaa ccactgggcagtcaaaatcgccggggggcttcccgga ggccaaccgtatcgccagcaagtacggattcatcaac ataggacagataggggccctgaaggactactaccact tctaccatagcaggacgattaaaaggtcagttatctcg agcagagggacccacagtttcatttcaatggaaccaa aggtggaatggatccaacagcaagtggtaaaaaagc ggacaaagagggattatgacttcagtcgtgcccagtct acctatttcaatgatcccaagtggcccagcatgtggtat atgcactgcagtgacaatacacatccctgccagtctga catgaatatcgaaggagcctggaagagaggctacac gggaaagaacattgtggtcactatcctggatgacgga attgagagaacccatccagatctgatgcaaaactacg atgctctggcaagttgcgacgtgaatgggaatgacttg gacccaatgcctcgttatgatgcaagcaacgagaaca gcatgggactcgctgtgctggagaagtggcagccg ctgcaaacaattcgcactgcacagtcggaattgctttc aacgccaagatcggaggagtgcgaatgctggacgg agatgtcacggacatggttgaagcaaaatcagttagct tcaaccccagcacgtgcacatttacagcgccagctg gggcccggatgatgatggcaagactgtggacggacc agcccccctcacccggcaagccttttgaaaacggcgtt agaatggggcggagaggcctcggctctgtgtttgtttg ggcatctggaaatggtggaaggagcaaagaccactg ctcctgtgatggctacaccaacagcatctacaccatct ccatcagcagcactgcagaaagcggaaagaaacctt ggtacctggaagagtgttcatccacgctggccacaac ctacagcagcggggagtcctacgataagaaaatcatc actacagatctgaggcagcgttgcacggacaaccac actgggacgtcagcctcagccccccatggctgcaggc atcattgcgctggccctggaagccaatccgtttctgac ctggagagactacagcatgttattgtcaggacttccc gtgcgggacatttgaacgctaatgactggaaaaccaa tgctgctggttttaaggtgacgcatcttttatggatttgga ctgatgacgcagaagccatggtgatggaggcagag aagtggaccaccgttcccggcagcacgtgtgtgtgg agagcacagaccgacaaatcaagacaatccgccta acagtcagtgcgctccatctacaaagcttcaggctg ctcggataaccccaacgcccatgtcaactacctggag cacgtcgttgtgcgcatcaccatcacccaccccagga gaggagacctggccatctacctgacctcgccctctgg aactaggtctcagcttttggccaacaggctatttgatca ctccatggaaggattcaaaaactgggagttcatgacc attcattgctggggagaaagagctgctggtgactggg tccttgaagtttatgatactccctctcagctaaggaactt taagactccaggtaaattgaaagaatggtctttggtcct ctacggcACCTCCGTGCAGCCCATATT caccaaccaatgaatttccgaaagtggaacggttccg ctatagccgagttgaagccccacagacgactatggc acagaggattatgcaggtccctgcgaccctgagtgca gtgaggttggctgtgacgggccaggaccagaccact gcaatgactgtttgcactactactacaagctgaaaaac aataccaggatctgtgtctccagctgccccctggcca ctaccacgccgacaagaagcgctgcaggaagtgtgc ccccaactgtgagtcctgcttttgggagccatggtgacc aatgcatgtcctgcaaatatggatactttctgaatgaag aaaccaacagctgttgttactcactgccctgatgggtca tatcaggataccaagaaaatctttgccggaaatgcag tgaaaactgcaagacatgtactgaattccataactgtac agaatgtagggatgggttaagcctgcagggatcccg | 611 |

TABLE 24-continued

FIX amino acid and nucleic acid sequences

| Name | Amino Acid Sequence | SEQ ID NO: | Nucleic Acid Sequences | SEQ ID NO: |
|------|---------------------|------------|------------------------|------------|
| | | | gtgctctgtctcctgtgaagatggacggtatttcaacgg<br>ccaggactgccagccctgccaccgcttctgcgccact<br>tgtgctggggcaggagctgatgggtgcattaactgca<br>cagagggctacttcatggaggatgggagatgcgtgc<br>agagctgtagtatcagctattactttgaccactcttcaga<br>gaatggatacaaatcctgcaaaaaatgtgatatcagtt<br>gtttgacgtgcaatggcccaggattcaagaactgtaca<br>agctgccctagtgggtatctcttagacttaggaatgtgt<br>caaatgggagccatttgcaaggatgcaacggaagag<br>tcctgggcggaaggaggcttctgtatgcttgtgaaaaa<br>gaacaatctgtgccaacggaaggttcttcaacaactttt<br>gctgcaaaacatgtacatttcaaggctga | |

Example 24

Construction of FIX-/FXI/-XTEN

Construction of FIX-TEV-XTEN_AE864 Genes and Vectors

The cloning vector containing the gene encoding FIX was purchased from OriGene (SC126517). PCR reactions were performed to abolish two BbsI restriction sites within the FIX coding region. The resulting FIX coding region was then amplified using primers that introduced NheI and SfiI-TEV-BsaI sequences on the 5' and 3' end respectively. The digested FIX fragment was fused to BsaI/HindIII digested XTEN_AE864 fragment and inserted into NheI/HindIII digested pSecTag2C expression vector. The ligated DNA mixture was electroporated into XL1-Blue bacterial cells. Transformants were screened by DNA miniprep and the desired constructs were confirmed by DNA sequencing. The final construct is pCW0648.001 which encodes the FIX-TEV-XTEN_AE864 protein (Table 25).

Construction of FIX-/FXI/-XTEN_AE864 Genes and Vectors

The TEV site was removed by digesting the pCW0648 expression vector with SfiI and BsaI. Oligos containing sequences that encode SfiI-KLTRAET-BsaI ('KLTRAET' disclosed as SEQ ID NO: 6), SfiI-DFTRVVG-BsaI ('DFTRVVG' disclosed as SEQ ID NO: 88), or SfiI-/FXI/-BsaI were annealed and ligated with the digested pCW0648 vector. The ligated DNA mixture was electroporated into XL1-Blue bacterial cells. Transformants were screened by DNA miniprep and the desired constructs were confirmed by DNA sequencing. The resulting expression vectors encode FIX-KLTRAET-XTEN_AE864 (pCW0735) ('KLTRAET' disclosed as SEQ ID NO: 6), FIX-DFTRVVG-XTEN_AE864 (pCW0736) ('DFTRVVG' disclosed as SEQ ID NO: 88) and FIX-/FXI/-XTEN_AE864 (pCW0737).

Construction of Expression Vectors Encoding FIX-/FXI/-XTEN_AE864 Genes Using Millipore Plasmids Expression vector pCW0735 was digested with NheI and SalI. The resulting 4181 bp fragment included nucleotides that encode the FIX-KLTRAET-XTEN_AE864 protein ('KLTRAET' disclosed as SEQ ID NO: 6). This fragment was ligated with NheI/SalI digested CET1019-HD-puro (Millipore) or DC HD-puro (Millipore). Both CET1019-HD-puro and DC-HD-puro feature dual cassettes where a CMV promoter lies upstream of the gene insertion site, CET1019-HD-puro also contains a UCOE element upstream of the promoter. The ligated DNA mixture was electroporated into XL1-Blue bacterial cells. Transformants were screened by DNA miniprep and the desired constructs were confirmed by DNA sequencing. The resulting expression vectors were pBC0033 (DC-HD-puro-FIX-KLTRAET-XTEN_AE864 ('KLTRAET' disclosed as SEQ ID NO: 6)) and pBC0034 (CET1019-HD-puro-FIX-KLTRAET-XTEN_AE864 ('KLTRAET' disclosed as SEQ ID NO: 6)) (Table 25).

TABLE 25

FIX-XTEN with cleavage sequence: amino acid and nucleic acid sequences

| Name | Amino Acid Sequence | SEQ ID NO: | Nucleic Acid Sequences | SEQ ID NO: |
|------|---------------------|------------|------------------------|------------|
| FIX-TEV-XTEN_AE864 | MQRVNMIMAESPGLITI<br>CLLGYLLSAECTVFLDH<br>ENANKILNRPKRYNSG<br>KLEEFVQGNLERECME<br>EKCSFEEAREVFENTER<br>TTEFWKQYVDGDQCES<br>NPCLNGGSCKDDINSYE<br>CWCPFGFEGKNCELDV<br>TCNIKNGRCEQFCKNS<br>ADNKVVCSCTEGYRLA<br>ENQKSCEPAVPFPCGRV<br>SVSQTSKLTRAETVFPD<br>VDYVNSTEAETILDNIT<br>QSTQSFNDFTRVVGGE<br>DAKPGQFPWQVVLNG | 612 | atgcagcgcgtgaacatgatcatggcagaatcacc<br>aggcctcatcaccatctgccttttaggatatctactc<br>agtgctgaatgtacagttttcttgatcatgaaaacg<br>ccaacaaaattctgaatcggccaaagaggtataatt<br>caggtaaattggaagagtttgttcaagggaaccttg<br>agagagaatgtatgggaagaaaagtgtagttttgaa<br>gaagcacgagaagttttgaaaacactgaaagaac<br>aactgaattttggaagcagtatgttgatggagatca<br>gtgtgagtccaatccatgtttaaatggcggcagttg<br>caaggatgacattaattcctatgaatgttggtgtccc<br>tttggatttgaaggaaagaactgtgaattagatgtaa<br>catgtaacattaagaatggcagatgcgagcagtttt<br>gtaaaaatagtgctgataacaaggtggtttgctcct<br>gtactgagggatatcgacttgcagaaaaccagaag<br>tcctgtgaaccagcagtgccatttccatgtggaaga | 613 |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | KVDAFCGGSIVNEKWI | | gtttctgtttcacaaacttctaagctcacccgtgctga | |
| | VTAAHCVETGVKITVV | | gactgttttcctgatgtggactatgtaaattctactga | |
| | AGEHNIEETEHTEQKRN | | agctgaaaccattttggataacatcactcaaagcac | |
| | VIRIIPHHNYNAAINKY | | ccaatcatttaatgacttcactcgggttgttggtgga | |
| | NHDIALLELDEPLVLNS | | gaagatgccaaaccaggtcaattcccttggcaggt | |
| | YVTPICIADKEYTNIFLK | | tgttttgaatggtaaagttgatgcattctgtggaggct | |
| | FGSGYVSGWGRVFHKG | | ctatcgttaatgaaaaatggattgtaactgctgccca | |
| | RSALVLQYLRVPLVDR | | ctgtgttgaaactggtgttaaaattacagttgtcgca | |
| | ATCLRSTKFTIYNNMFC | | ggtgaacataatattgaggagacagaacatacaga | |
| | AGFHEGGRDSCQGDSG | | gcaaaagcgaaatgtgattcgaattattcctcacca | |
| | GPHVTEVEGTSFLTGIIS | | caactacaatgcagctattaataagtacaaccatga | |
| | WGEECAMKGKYGIYT | | cattgcccttctggaactggacgaacccttagtgct | |
| | KVSRYVNWIKEKTKLT | | aaacagctacgttacacctatttgcattgctgacaag | |
| | GPEGPSENLYFQGGSPG | | gaatacacgaacatcttcctcaaatttggatctggct | |
| | SPAGSPTSTEEGTSESAT | | atgtaagtggctggggaagagtGttccacaaagg | |
| | PESGPGTSTEPSEGSAP | | gagatcagctttagttcttcagtaccttagagttccac | |
| | GSPAGSPTSTEEGTSTEP | | ttgttgaccgagccacatgtctAcgatctacaaagt | |
| | SEGSAPGTSTEPSEGSA | | tcaccatctataacaacatgttctgtgctggcttccat | |
| | PGTSESATPESGPGSEP | | gaaggaggtagagattcatgtcaaggagatagtg | |
| | ATSGSETPGSEPATSGS | | ggggaccccatgttactgaagtggaagggaccag | |
| | ETPGSPAGSPTSTEEGTS | | tttcttaactggaattattagctggggtgaagagtgt | |
| | ESATPESGPGTSTEPSEG | | gcaatgaaaggcaaatatggaatatataccaaggt | |
| | SAPGTSTEPSEGSAPGSP | | atcccggtatgtcaactggattaaggaaaaaacaa | |
| | AGSPTSTEEGTSTEPSE | | agctcactGGCCCAGAAGGCCCAtcc | |
| | GSAPGTSTEPSEGSAPG | | gaaaatctgtattttcagggtGGGTCTCCAG | |
| | TSESATPESGPGTSTEPS | | GTTCTCCAGCCGGGTCCCAAC | |
| | EGSAPGTSESATPESGP | | TTCGACCGAGGAAGGGACCTC | |
| | GSEPATSGSETPGTSTEP | | CGAGTCAGCTACCCCGGAGTCC | |
| | SEGSAPGTSTEPSEGSA | | GGTCCTGGCACCTCCACCGAAC | |
| | PGTSESATPESGPGTSES | | CATCGGAGGGCAGCGCCCCTG | |
| | ATPESGPGSPAGSPTST | | GGAGCCCTGCCGGGAGCCCTA | |
| | EEGTSESATPESGPGSEP | | CAAGCACCGAAGAGGGCACCA | |
| | ATSGSETPGTSESATPES | | GTACAGAGCCAAGTGAGGGGA | |
| | GPGTSTEPSEGSAPGTS | | GCGCCCCTGGTACTAGTACTGA | |
| | TEPSEGSAPGTSTEPSEG | | ACCATCCGAGGGGTCAGCTCCA | |
| | SAPGTSTEPSEGSAPGT | | GGCACGAGTGAGTCCGCTACCC | |
| | STEPSEGSAPGTSTEPSE | | CCGAGAGCGGACCGGGCTCAG | |
| | GSAPGSPAGSPTSTEEG | | AGCCCGCCACGAGTGGCAGTG | |
| | TSTEPSEGSAPGTSESAT | | AAACTCCAGGCTCAGAACCCG | |
| | PESGPGSEPATSGSETP | | CCACTAGTGGGTCAGAGACTCC | |
| | GTSESATPESGPGSEPA | | AGGCAGCCCTGCCGGATCCCCT | |
| | TSGSETPGTSESATPESG | | ACGTCCACCGAGGAGGGAACA | |
| | PGTSTEPSEGSAPGTSES | | TCTGAGTCCGCAACACCCGAAT | |
| | ATPESGPGSPAGSPTST | | CCGGTCCAGGCACCTCCACGGA | |
| | EEGSPAGSPTSTEEGSP | | ACCTAGTGAAGGCTCGGCACC | |
| | AGSPTSTEEGTSESATP | | AGGTACAAGCACCGAACCTAG | |
| | ESGPGTSTEPSEGSAPG | | CGAGGGCAGCGCTCCCGGCAG | |
| | TSESATPESGPGSEPATS | | CCCTGCCGGCAGCCCAACCTCA | |
| | GSETPGTSESATPESGP | | ACTGAGGAGGGCACCAGTACT | |
| | GSEPATSGSETPGTSES | | GAGCCCAGCGAGGGATCAGCA | |
| | ATPESGPGTSTEPSEGS | | CCTGGCACCAGCACCGAACCTA | |
| | APGSPAGSPTSTEEGTS | | GCGAGGGGAGCGCCCCTGGGA | |
| | ESATPESGPGSEPATSG | | CTAGCGAGTCAGCTACACCAG | |
| | SETPGTSESATPESGPGS | | AGAGCGGGCCTGGAACTTCTAC | |
| | PAGSPTSTEEGSPAGSP | | CGAACCCAGTGAGGGATCCGC | |
| | TSTEEGTSTEPSEGSAP | | TCCAGGCACCTCCGAATCCGCA | |
| | GTSESATPESGPGTSES | | ACCCCCGAATCCGGACCTGGCT | |
| | ATPESGPGTSESATPES | | CAGAGCCCGCCACCAGCGGGA | |
| | GPGSEPATSGSETPGSE | | GCGAAACCCCTGGCACATCCAC | |
| | PATSGSETPGSPAGSPTS | | CGAGCCTAGCGAAGGGTCCGC | |
| | TEEGTSTEPSEGSAPGT | | ACCCGGCACCAGTACAGAGCC | |
| | STEPSEGSAPGSEPATS | | TAGCGAGGGATCAGCACCTGG | |
| | GSETPGTSESATPESGP | | CACCAGTGAATCTGCTACACCA | |
| | GTSTEPSEGSAPGSSS | | GAGAGCGGCCCTGGAACCTCC | |
| | | | GAGTCCGCTACCCCCGAGAGC | |
| | | | GGGCCAGGTTCTCCTGCTGGCT | |
| | | | CCCCCACCTCAACAGAAGAGG | |
| | | | GGACAAGCGAAAGCGCTACGC | |
| | | | CTGAGAGTGGCCCTGGCTCTGA | |
| | | | GCCAGCCACCTCCGGCTCTGAA | |
| | | | ACCCCTGGCACTAGTGAGTCTG | |
| | | | CCACGCCTGAGTCCGGACCCGG | |
| | | | GACCTCTACTGAGCCCTCGGAG | |
| | | | GGGAGCGCTCCTGGCACGAGT | |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | | | ACAGAACCTTCCGAAGGAAGT | |
| | | | GCACCGGGCACAAGCACCGAG | |
| | | | CCTTCCGAAGGCTCTGCTCCCG | |
| | | | GAACCTCTACCGAACCCTCTGA | |
| | | | AGGGTCTGCACCCGGCACGAG | |
| | | | CACCGAACCCAGCGAAGGGTC | |
| | | | AGCGCCTGGGACCTCAACAGA | |
| | | | GCCCTCGGAAGGATCAGCGCCT | |
| | | | GGAAGCCCTGCAGGGAGTCCA | |
| | | | ACTTCCACGGAAGAAGGAACG | |
| | | | TCTACAGAGCCATCAGAGGGG | |
| | | | TCCGCACCAGGTACCAGCGAAT | |
| | | | CCGCTACTCCCGAATCTGGCCC | |
| | | | TGGGTCCGAACCTGCCACCTCC | |
| | | | GGCTCTGAAACTCCAGGGACCT | |
| | | | CCGAATCTGCCACACCCGAGA | |
| | | | GCGGCCCTGGCTCCGAGCCCGC | |
| | | | AACATCTGGCAGCGAGACACC | |
| | | | TGGCACCTCCGAGAGCGCAAC | |
| | | | ACCCGAGAGCGGCCCTGGCAC | |
| | | | CAGCACCGAGCCATCCGAGGG | |
| | | | ATCCGCCCCAGGCACTTCTGAG | |
| | | | TCAGCCACACCCGAAAGCGGA | |
| | | | CCAGGATCACCCGCTGGCTCCC | |
| | | | CCACCAGTACCGAGGAGGGGT | |
| | | | CCCCCGCTGGAAGTCCAACAA | |
| | | | GCACTGAGGAAGGGTCCCCTG | |
| | | | CCGGCTCCCCCACAAGTACCGA | |
| | | | AGAGGGCACAAGTGAGAGCGC | |
| | | | CACTCCCGAGTCCGGGCCTGGC | |
| | | | ACCAGCACAGAGCCTTCCGAG | |
| | | | GGGTCCGCACCAGGTACCTCAG | |
| | | | AGTCTGCTACCCCCGAGTCAGG | |
| | | | GCCAGGATCAGAGCCAGCCAC | |
| | | | CTCCGGGTCTGAGACACCCGGG | |
| | | | ACTTCCGAGAGTGCCACCCCTG | |
| | | | AGTCCGGACCCGGGTCCGAGC | |
| | | | CCGCCACTTCCGGCTCCGAAAC | |
| | | | TCCCGGCACAAGCGAGAGCGC | |
| | | | TACCCCAGAGTCAGGACCAGG | |
| | | | AACATCTACAGAGCCCTCTGAA | |
| | | | GGCTCCGCTCCAGGGTCCCCAG | |
| | | | CCGGCAGTCCCACTAGCACCGA | |
| | | | GGAGGGAACCTCTGAAAGCGC | |
| | | | CACACCCGAATCAGGGCCAGG | |
| | | | GTCTGAGCCTGCTACCAGCGGC | |
| | | | AGCGAGACACCAGGCACCTCT | |
| | | | GAGTCCGCCACACCAGAGTCC | |
| | | | GGACCCGGATCTCCCGCTGGGA | |
| | | | GCCCCACCTCCACTGAGGAGG | |
| | | | GATCTCCTGCTGGCTCTCCAAC | |
| | | | ATCTACTGAGGAAGGTACCTCA | |
| | | | ACCGAGCCATCCGAGGGATCA | |
| | | | GCTCCCGGCACCTCAGAGTCGG | |
| | | | CAACCCCGGAGTCTGGACCCG | |
| | | | GAACTTCCGAAAGTGCCACACC | |
| | | | AGAGTCCGGTCCCGGGACTTCA | |
| | | | GAATCAGCAACACCCGAGTCC | |
| | | | GGCCCTGGGTCTGAACCCGCCA | |
| | | | CAAGTGGTAGTGAGACACCAG | |
| | | | GATCAGAACCTGCTACCTCAGG | |
| | | | GTCAGAGACACCCGGATCTCCG | |
| | | | GCAGGCTCACCAACCTCCACTG | |
| | | | AGGAGGGCACCAGCACAGAAC | |
| | | | CAAGCGAGGGCTCCGCACCCG | |
| | | | GAACAAGCACTGAACCCAGTG | |
| | | | AGGGTTCAGCACCCGGCTCTGA | |
| | | | GCCGGCCACAAGTGGCAGTGA | |
| | | | GACACCCGGCACTTCAGAGAG | |
| | | | TGCCACCCCCGAGAGTGGCCCA | |
| | | | GGCACTAGTACCGAGCCCTCTG | |
| | | | AAGGCAGTGCGCCAGGTTCGTC | |
| | | | TTCATAA | |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| FIX-KLTRAET-XTEN_AE864 ('KLTRAET' disclosed as SEQ ID NO: 6) | MQRVNMIMAESPGLITI CLLGYLLSAECTVFLDH ENANKILNRPKRYNSG KLEEFVQGNLERECME EKCSFEEAREVFENTER TTEFWKQYVDGDQCES NPCLNGGSCKDDINSYE CWCPFGFEGKNCELDV TCNIKNGRCEQFCKNS ADNKVVCSCTEGYRLA ENQKSCEPAVPFPCGRV SVSQTSKLTRAETVFPD VDYVNSTEAETILDNIT QSTQSFNDFTRVVGGE DAKPGQFPWQVVLNG KVDAFCGGSIVNEKWI VTAAHCVETGVKITVV AGEHNIEETEHTEQKRN VIRIIPHHNYNAAINKY NHDIALLELDEPLVLNS YVTPICIADKEYTNIFLK FGSGYVSGWGRVFHKG RSALVLQYLRVPLVDR ATCLRSTKFTIYNNMFC AGFHEGGRDSCQGDSG GPHVTEVEGTSFLTGIIS WGEECAMKGKYGIYT KVSRYVNWIKEKTKLT GPEGPSKLTRAETGSPG SPAGSPTSTEEGTSESAT PESGPGTSTEPSEGSAP GSPAGSPTSTEEGTSTEP SEGSAPGTSTEPSEGSA PGTSESATPESGPGSEP ATSGSETPGSEPATSGS ETPGSPAGSPTSTEEGTS ESATPESGPGTSTEPSEG SAPGTSTEPSEGSAPGSP AGSPTSTEEGTSTEPSE GSAPGTSTEPSEGSAPG TSESATPESGPGTSTEPS EGSAPGTSESATPESGP GSEPATSGSETPGTSTEP SEGSAPGTSTEPSEGSA PGTSESATPESGPGTSES ATPESGPSPAGSPTST EEGTSESATPESGPGSEP ATSGSETPGTSESATPES GPGTSTEPSEGSAPGTS TEPSEGSAPGTSTEPSEG SAPGTSTEPSEGSAPGT STEPSEGSAPGTSTEPSE GSAPGSPAGSPTSTEEG TSTEPSEGSAPGTSESAT PESGPGSEPATSGSETP GTSESATPESGPGSEPA TSGSETPGTSESATPESG PGTSTEPSEGSAPGTSES ATPESGPSPAGSPTST EEGSPAGSPTSTEEGSP AGSPTSTEEGTSESATP ESGPGTSTEPSEGSAPG TSESATPESGPGSEPATS GSETPGTSESATPESGP GSEPATSGSETPGTSES ATPESGPGTSTEPSEGS APGSPAGSPTSTEEGTS ESATPESGPGSEPATSG SETPGTSESATPESGPGS PAGSPTSTEEGSPAGSP TSTEEGTSTEPSEGSAP GTSESATPESGPGTSES ATPESGPGTSESATPES GPGSEPATSGSETPGSE | 614 | atgcagcgcgtgaacatgatcatggcagaatcacc aggcctcatcaccatctgccttttaggatatctactc agtgctgaatgtacagttttcttgatcatgaaaacg ccaacaaaattctgaatcggccaaagaggtataat caggtaaattggaagagtttgttcaagggaacctt g agagagaatgtatggaagaaaagtgtagttttgaa gaagcacgagaagttttgaaaacactgaaagaac aactgaattttggaagcagtatgttgatggagatca gtgtgagtccaatccatgttaaatggcggcagttg caaggatgacattaattcctatgaatgttggtgtccc tttggatttgaaggaaagaactgtgaattagatgta a catgtaacattaagaatggcagatgcgagcagttt t gtaaaaatagtgctgataacaaggtggtttgctcct gtactgagggatatcgacttgcagaaaccagaag tcctgtgaaccagcagtgccatttccatgtggaaga gttttctgtttcacaaacttctaagctcacccgtgctg a gactgtttttcctgatgtggactatgtaaattctact g a agctgaaaccattttggataacatcactcaaagcac ccaatcatttaatgacttcactcgggttgttggtgga gaagatgccaaaccaggtcaattccctttggcaggt tgttttgaatggtaaagttgatgcattctgtggaggct ctatcgttaatgaaaaatggattgtaactgctgccca ctgtgttgaaactggtgttaaaattacagttgtcgca ggtgaacataatattgaggagacagaacatacaga gcaaaagcgaaatgtgattcgaattattcctcacca caactacaatgcagctattaataagtacaaccatga cattgcccttctggaactggacgaacccttagtgct aaacagctacgttacacctatttgcattgctgacaag aatacacgaacatcttcctcaaatttggatctggct atgtaagtggctggggaagagtGttccacaaagg gagatcagctttagttcttcagtaccttagagttccac ttgttgaccgagccacatgtctAcgatctacaaagt tcaccatctataacaacatgttctgtgctggcttccat gaaggaggtagagattcatgtcaaggagatagtg ggggaccccatgttactgaagtggaagggaccag tttcttaactggaattattagctggggtgaagagtgt gcaatgaaaggcaaatatggaatatataccaaggt atcccggtatgtcaactggattaaggaaaaaacaa agctcactGGCCCAGAAGGCCCAtcc aagctAacGcgtgcGgagacAGGGTCTC CAGGTTCTCCAGCCGGGTCCCC AACTTCGACCGAGGAAGGGAC CTCCGAGTCAGCTACCCCGGAG TCCGGTCCTGGCACCTCCACCG AACCATCGGAGGGCAGCGCCC CTGGGAGCCCTGCCGGGAGCC CTACAAGCACCGAAGAGGGCA CCAGTACAGAGCCAAGTGAGG GGAGCGCCCCTGGTACTAGTAC TGAACCATCCGAGGGGTCAGCT CCAGGCACGAGTGAGTCCGCT ACCCCCGAGAGCGGACCGGGC TCAGAGCCGCCACGAGTGGC AGTGAAACTCCAGGCTCAGAA CCCGCCACTAGTGGGTCAGAG ACTCCAGGCAGCCCTGCCGGAT CCCCTACGTCCACCGAGGAGG GAACATCTGAGTCCGCAACACC CGAATCCGGTCCAGGCACCTCC ACGGAACCTAGTGAAGGCTCG GCACCAGGTACAAGCACCGAA CCTAGCGAGGGCAGCGCTCCC GGCAGCCCTGCCGGCAGCCCA ACCTCAACTGAGGAGGGCACC AGTACTGAGCCCAGCGAGGGA TCAGCACCTGGCACCAGCACCG AACTAGCGAGGGGAGCGCCC CTGGGACTAGCGAGTCAGCTAC ACCAGAGAGCGGGCCTGGAAC TTCTACCGAACCCAGTGAGGGA TCCGCTCCAGGCACCTCCGAAT CCGCAACCCCCGAATCCGGACC TGGCTCAGAGCCCGCCACCAGC GGGAGCGAAACCCCTGGCACA | 615 |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | PATSGSETPGSPAGSPTS TEEGTSTEPSEGSAPGT STEPSEGSAPGSEPATS GSETPGTSESATPESGP GTSTEPSEGSAPGSSS | | TCCACCGAGCCTAGCGAAGGG TCCGCACCCGGCACCAGTACAG AGCCTAGCGAGGGATCAGCAC CTGGCACCAGTGAATCTGCTAC ACCAGAGAGCGGCCCTGGAAC CTCCGAGTCCGCTACCCCCGAG AGCGGGCCAGGTTCTCCTGCTG GCTCCCCCACCTCAACAGAAGA GGGGACAAGCGAAAGCGCTAC GCCTGAGAGTGGCCCTGGCTCT GAGCCAGCCACCTCCGGCTCTG AAACCCCTGGCACTAGTGAGTC TGCCACGCCTGAGTCCGGACCC GGGACCTCTACTGAGCCCTCGG AGGGGAGCGCTCCTGGCACGA GTACAGAACCTTCCGAAGGAA GTGCACCGGGCACAAGCACCG AGCCTTCCGAAGGCTCTGCTCC CGGAACCTCTACCGAACCCTCT GAAGGGTCTGCACCCGGCACG AGCACCGAACCCAGCGAAGGG TCAGCGCCTGGGACCTCAACAG AGCCCTCGGAAGGATCAGCGC CTGGAAGCCCTGCAGGGAGTC CAACTTCCACGGAAGAAGGAA CGTCTACAGAGCCATCAGAGG GGTCCGCACCAGGTACCAGCG AATCCGCTACTCCCGAATCTGG CCCTGGGTCCGAACCTGCCACC TCCGGCTCTGAAACTCCAGGGA CCTCCGAATCTGCCACACCCGA GAGCGGCCCTGGCTCCGAGCCC GCAACATCTGGCAGCGAGACA CCTGGCACCTCCGAGAGCGCA ACACCCGAGAGCGGCCCTGGC ACCAGCACCGAGCCATCCGAG GGATCCGCCCCAGGCACTTCTG AGTCAGCCACACCCGAAAGCG GACCAGGATCACCCGCTGGCTC CCCCACCAGTACCGAGGAGGG GTCCCCCGCTGGAAGTCCAACA AGCACTGAGGAAGGGTCCCCT GCCGGCTCCCCCACAAGTACCG AAGAGGGCACAAGTGAGAGCG CCACTCCCGAGTCCGGGCCTGG CACCAGCACAGAGCCTTCCGA GGGGTCCGCACCAGGTACCTCA GAGTCTGCTACCCCGAGTCAG GGCCAGGATCAGAGCCAGCCA CCTCCGGGTCTGAGACACCCGG GACTTCCGAGAGTGCCACCCCT GAGTCCGGACCCGGGTCCGAG CCCGCCACTTCCGGCTCCGAAA CTCCCGGCACAAGCGAGAGCG CTACCCCAGAGTCAGGACCAG GAACATCTACAGAGCCCTCTGA AGGCTCCGCTCCAGGGTCCCCA GCCGGCAGTCCCACTAGCACCG AGGAGGGAACCTCTGAAAGCG CCACACCCGAATCAGGGCCAG GGTCTGAGCCTGCTACCAGCGG CAGCGAGACACCAGGCACCTC TGAGTCCGCCACACCAGAGTCC GGACCCGGATCTCCCGCTGGGA GCCCCACCTCCACTGAGGAGG GATCTCCTGCTGGCTCTCCAAC ATCTACTGAGGAAGGTACCTCA ACCGAGCCATCCGAGGGATCA GCTCCCGGCACCTCAGAGTCGG CAACCCCGGAGTCTGGACCCG GAACTTCCGAAAGTGCCACACC AGAGTCCGGTCCCGGGACTTCA GAATCAGCAACACCCGAGTCC GGCCCTGGGTCTGAACCCGCCA | |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | | | CAAGTGGTAGTGAGACACCAG GATCAGAACCTGCTACCTCAGG GTCAGAGACACCCGGATCTCCG GCAGGCTCACCAACCTCCACTG AGGAGGGCACCAGCACAGAAC CAAGCGAGGGCTCCGCACCCG GAACAAGCACTGAACCCAGTG AGGGTTCAGCACCCGGCTCTGA GCCGGCCACAAGTGGCAGTGA GACACCCGGCACTTCAGAGAG TGCCACCCCCGAGAGTGGCCCA GGCACTAGTACCGAGCCCTCTG AAGGCAGTGCGCCAGGTTCGTC TTCATAA | |
| FIX-DFTRVVG-XTEN_AE864 | MQRVNMIMAESPGLITI CLLGYLLSAECTVFLDH ENANKILNRPKRYNSG KLEEFVQGNLERECME EKCSFEEAREVFENTER TTEFWKQYVDGDQCES NPCLNGGSCKDDINSYE CWCPFGFEGKNCELDV TCNIKNGRCEQFCKNS ADNKVVCSCTEGYRLA ENQKSCEPAVPFPCGRV SVSQTSKLTRAETVFPD VDYVNSTEAETILDNIT QSTQSFNDFTRVVGGE DAKPGQFPWQVVLNG KVDAFCGGSIVNEKWI VTAAHCVETGVKITVV AGEHNIEETEHTEQKRN VIRIIPHHNYNAAINKY NHDIALLELDEPLVLNS YVTPICIADKEYTNIFLK FGSGYVSGWGRVFHKG RSALVLQYLRVPLVDR ATCLRSTKFTIYNNMFC AGFHEGGRDSCQGDSG GPHVTEVGTSFLTGIIS WGEECAMKGKYGIYT KVSRYVNWIKEKTKLT GPEGPSDFTRVVGGSPG SPAGSPTSTEEGTSESAT PESGPGTSTEPSEGSAP GSPAGSPTSTEEGTSTEP SEGSAPGTSTEPSEGSA PGTSESATPESGPGSEP ATSGSETPGSEPATSGS ETPGSPAGSPTSTEEGTS ESATPESGPGTSTEPSEG SAPGTSTEPSEGSAPGSP AGSPTSTEEGTSTEPSE GSAPGTSTEPSEGSAPG TSESATPESGPGTSTEPS EGSAPGTSESATPESGP GSEPATSGSETPGTSTEP SEGSAPGTSTEPSEGSA PGTSESATPESGPGTSES ATPESGPSPAGSPTST EEGTSESATPESGPGSEP ATSGSETPGTSESATPES GPGTSTEPSEGSAPGTS TEPSEGSAPGTSTEPSEG SAPGTSTEPSEGSAPGT STEPSEGSAPGTSTEPSE GSAPGSPAGSPTSTEEG TSTEPSEGSAPGTSESAT PESGPGSEPATSGSETP GTSESATPESGPGSEPA TSGSETPGTSESATPESG PGTSTEPSEGSAPGTSES ATPESGPGSPAGSPTST | 616 | atgcagcgcgtgaacatgatcatggcagaatcacc aggcctcatcaccatctgccttttaggatatctactc agtgctgaatgtacagttttcttgatcatgaaaacg ccaacaaaattctgaatcggccaaagaggtataatt caggtaaattggaagagtttgttcaagggaaccttg agagagaatgtatggaagaaaagtgtagttttgaa gaagcacgagaagttttgaaaacactgaaagaac aactgaattttggaagcagtatgtcgatggagatca gtgtgagtccaatccatgtttaaatggcggcagttg caaggatgacattaattcctatgaatgttggtgtccc tttggatttgaaggaaagaactgtgaattagatgtaa catgtaacattaagaatggcagatgcgagcagtttt gtaaaaatagtgctgataacaaggtggtttgctcct gtactgagggatatcgacttgcagaaaaccagaag tcctgtgaaccagcagtgccatttccatgtggaaga gtttctgtttcacaaacttctaagctcacccgtgctga gactgtttttcctgatgtggactatgtaaattctactga agctgaaaccattttggataacatcactcaaagcac ccaatcatttaatgacttcactcgggttgttggtgga gaagatgccaaaccaggtcaattcccttggcaggt tgttttgaatggtaaagttgatgcattctgtgggagct ctatcgttaatgaaaaatggattgtaactgctgccca ctgtgttgaaactggtgttaaaattacagttgtcgca ggtgaacataatattgaggagacagaacatacaga gcaaaagcgaaatgtgattcgaattattcctcacca caactacaatgcagctattaataagtacaaccatga cattgcccttctggaactggacgaacccttagtgct aaacagctacgttacacctatttgcattgctgacaag gaatacacgaacatcttcctcaaatttggatctggct atgtaagtggctggggaagagtgttccacaaagg gagatcagctttagttcttcagtaccttagagttccac ttgttgaccgagccacatgtctAcgatctacaaagt tcaccatctataacaacatgttctgtgctggcttccat gaaggaggtagagattcatgtcaaggagatagtg ggggaccccatgttactgaagtggaagggaccag tttcttaactggaattattagctggggtgaagagtgt gcaatgaaaggcaaatatggaatatataccaaggt atcccggtatgtcaactggattaaggaaaaaacaa agctcactGGCCCAGAAGGCCCAtcc gacttcacAcgggtAgttggCGGGTCTCC AGGTTCTCCAGCCGGGTCCCCA ACTTCGACCGAGGAAGGGACC TCCGAGTCAGCTACCCCGGAGT CCGGTCCTGCACCTCCACCGA ACCATCGGAGGGCAGCGCCCC TGGGAGCCCTGCCGGGAGCCCT ACAAGCACCGAAGAGGGCACC AGTACAGAGCCAAGTGAGGGG AGCGCCCCTGGTACTAGTACTG AACCATCCGAGGGGTCAGCTCC AGGCACGAGTGAGTCCGCTAC CCCCGAGAGCGGACCGGGCTC AGAGCCCGCCACGAGTGGCAG TGAAACTCCAGGCTCAGAACCC GCCACTAGTGGGTCAGAGACTC CAGGCAGCCCTGCCGGATCCCC TACGTTCCACCGAGGAGGGAAC ATCTGAGTCCGCAACACCCGAA TCCGGTCCAGGCACCTCCACGG | 617 |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | EEGSPAGSPTSTEEGSP<br>AGSPTSTEEGTSESATP<br>ESGPGTSTEPSEGSAPG<br>TSESATPESGPGSEPATS<br>GSETPGTSESATPESGP<br>GSEPATSGSETPGTSES<br>ATPESGPGTSTEPSEGS<br>APGSPAGSPTSTEEGTS<br>ESATPESGPGSEPATSG<br>SETPGTSESATPESGPGS<br>PAGSPTSTEEGSPAGSP<br>TSTEEGTSTEPSEGSAP<br>GTSESATPESGPGTSES<br>ATPESGPGTSESATPES<br>GPGSEPATSGSETPGSE<br>PATSGSETPGSPAGSPTS<br>TEEGTSTEPSEGSAPGT<br>STEPSEGSAPGSEPATS<br>GSETPGTSESATPESGP<br>GTSTEPSEGSAPGSSS | | AACCTAGTGAAGGCTCGGCAC<br>CAGGTACAAGCACCGAACCTA<br>GCGAGGGCAGCGCTCCCGGCA<br>GCCCTGCCGGCAGCCCAACCTC<br>AACTGAGGAGGGCACCAGTAC<br>TGAGCCCAGCGAGGGATCAGC<br>ACCTGGCACCAGCACCGAACCT<br>AGCGAGGGGAGCGCCCCTGGG<br>ACTAGCGAGTCAGCTACACCA<br>GAGAGCGGGCCTGGAACTTCT<br>ACCGAACCCAGTGAGGGATCC<br>GCTCCAGGCACCTCCGAATCCG<br>CAACCCCCGAATCCGGACCTGG<br>CTCAGAGCCCGCCACCAGCGG<br>GAGCGAAACCCCTGGCACATC<br>CACCGAGCCTAGCGAAGGGTC<br>CGCACCCGGCACCAGTACAGA<br>GCCTAGCGAGGGATCAGCACC<br>TGGCACCAGTGAATCTGCTACA<br>CCAGAGAGCGGCCCTGGAACC<br>TCCGAGTCCGCTACCCCCGAGA<br>GCGGGCCAGGTTCTCCTGCTGG<br>CTCCCCCACCTCAACAGAAGAG<br>GGGACAAGCGAAAGCGCTACG<br>CCTGAGAGTGGCCCTGGCTCTG<br>AGCCAGCCACCTCCGGCTCTGA<br>AACCCCTGGCACTAGTGAGTCT<br>GCCACGCCTGAGTCCGGACCCG<br>GGACCTCTACTGAGCCCTCGGA<br>GGGGAGCGCTCCTGGCACGAG<br>TACAGAACCTTCCGAAGGAAG<br>TGCACCGGGCACAAGCACCGA<br>GCCTTCCGAAGGCTCTGCTCCC<br>GGAACCTCTACCGAACCCTCTG<br>AAGGGTCTGCACCCGGCACGA<br>GCACCGAACCCAGCGAAGGGT<br>CAGCGCCTGGGACCTCAACAG<br>AGCCCTCGGAAGGATCAGCGC<br>CTGGAAGCCCTGCAGGGAGTC<br>CAACTTCCACGGAAGAAGGAA<br>CGTCTACAGAGCCATCAGAGG<br>GGTCCGCACCAGGTACCAGCG<br>AATCCGCTACTCCCGAATCTGG<br>CCCTGGGTCCGAACCTGCCACC<br>TCCGGCTCTGAAACTCCAGGGA<br>CCTCCGAATCTGCCACACCCGA<br>GAGCGGCCCTGGCTCCGAGCCC<br>GCAACATCTGGCAGCGAGACA<br>CCTGGCACCTCCGAGAGCGCA<br>ACACCCGAGAGCGGCCCTGGC<br>ACCAGCACCGAGCCATCCGAG<br>GGATCCGCCCCAGGCACTTCTG<br>AGTCAGCCACACCCGAAAGCG<br>GACCAGGATCACCCGCTGGCTC<br>CCCCACCAGTACCGAGGAGGG<br>GTCCCCCGCTGGAAGTCCAACA<br>AGCACTGAGGAAGGGTCCCCT<br>GCCGGCTCCCCCACAAGTACCG<br>AAGAGGGCACAAGTGAGAGCG<br>CCACTCCCGAGTCCGGGCCTGG<br>CACCAGCACAGAGCCTTCCGA<br>GGGGTCCGCACCAGGTACCTCA<br>GAGTCTGCTACCCCCGAGTCAG<br>GGCCAGGATCAGAGCCAGCCA<br>CCTCCGGGTCTGAGACACCCGG<br>GACTTCCGAGAGTGCCACCCCT<br>GAGTCCGGACCCGGGTCCGAG<br>CCCGCCACTTCCGGCTCCGAAA<br>CTCCCGGCACAAGCGAGAGCG<br>CTACCCCAGAGTCAGGACCAG<br>GAACATCTACAGAGCCCTCTGA<br>AGGCTCCGCTCCAGGGTCCCCA<br>GCCGGCAGTCCCACTAGCACCG<br>AGGAGGGAACCTCTGAAAGCG | |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | | | CCACACCCGAATCAGGGCCAG GGTCTGAGCCTGCTACCAGCGG CAGCGAGACACCAGGCACCTC TGAGTCCGCCACACCAGAGTCC GGACCCGGATCTCCCGCTGGGA GCCCCACCTCCACTGAGGAGG GATCTCCTGCTGGCTCTCCAAC ATCTACTGAGGAAGGTACCTCA ACCGAGCCATCCGAGGGATCA GCTCCCGGCACCTCAGAGTCGG CAACCCCGGAGTCTGGACCCG GAACTTCCGAAAGTGCCACACC AGAGTCCGGTCCCGGGACTTCA GAATCAGCAACACCCGAGTCC GGCCCTGGGTCTGAACCCGCCA CAAGTGGTAGTGAGACACCAG GATCAGAACCTGCTACCTCAGG GTCAGAGACACCCGGATCTCCG GCAGGCTCACCAACCTCCACTG AGGAGGGCACCAGCACAGAAC CAAGCGAGGGCTCCGCACCCG GAACAAGCACTGAACCCAGTG AGGGTTCAGCACCCGGCTCTGA GCCGGCCACAAGTGGCAGTGA GACACCCGGCACTTCAGAGAG TGCCACCCCCGAGAGTGGCCCA GGCACTAGTACCGAGCCCTCTG AAGGCAGTGCGCCAGGTTCGTC TTCATAA | |
| FIX-/FXI/-XTEN_AE864 | MQRVNMIMAESPGLITI CLLGYLLSAECTVFLDH ENANKILNRPKRYNSG KLEEFVQGNLERECME EKCSFEEAREVFENTER TTEFWKQYVDGDQCES NPCLNGGSCKDDINSYE CWCPFGFEGKNCELDV TCNIKNGRCEQFCKNS ADNKVVCSCTEGYRLA ENQKSCEPAVPFPCGRV SVSQTSKLTRAETVFPD VDYVNSTEAETILDNIT QSTQSFNDFTRVVGGE DAKPGQFPWQVVLNG KVDAFCGGSIVNEKWI VTAAHCVETGVKITVV AGEHNIEETEHTEQKRN VRIIPHHNYNAAINKY NHDIALLELDEPLVLNS YVTPICIADKEYTNIFLK FGSGYVSGWGRVFHKG RSALVLQYLRVPLVDR ATCLRSTKFTIYNNMFC AGFHEGGRDSCQGDSG GPHVTEVEGTSFLTGIIS WGEECAMKGKYGIYT KVSRYVNWIKEKTKLT GPEQTSKLTRAETVFPG SPAGSPTSTEEGTSESAT PESGPGTSTEPSEGSAP GSPAGSPTSTEEGTSTEP SEGSAPGTSTEPSEGSA PGTSESATPESGPGSEP ATSGSETPGSPATSGS ETPGSPAGSPTSTEEGTS ESATPESGPGTSTEPSEG SAPGTSTEPSEGSAPGSP AGSPTSTEEGTSTEPSE GSAPGTSTEPSEGSAPG TSESATPESGPGTSTEPS EGSAPGTSESATPESGP GSEPATSGSETPGTSTEP SEGSAPGTSTEPSEGSA | 618 | atgcagcgcgtgaacatgatcatggcagaatcacc aggcctcatcaccatctgccttttaggatatctactc agtgctgaatgtacagttttcttgatcatgaaaacg ccaacaaaattctgaatcggccaaagaggtataatt caggtaaattggaagagtttgttcaagggaaccttg agagagaatgtatggaagaaaagtgtagttttgaa gaagcacgagaagtttttgaaaacactgaaagaac aactgaattttggaagcagtatgttgatggagatca gtgtgagtccaatccatgtttaaatggcggcagttg caaggatgacattaattcctatgaatgttggtgtccc tttggatttgaaggaaagaactgtgaattagatgtaa catgtaacattaagaatggcagatgcgagcagtttt gtaaaaatagtgctgataacaaggtggtttgctcct gtactgagggatatcgacttgcagaaaaaccagaag tcctgtgaaccagcagtgccatttccatgtggaaga gtttctgtttcacaaacttctaagctcacccgtgctga gactgttttcctgatgtggactatgtaaattctactga agctgaaaccattttggataacatcactcaaagcac ccaatcattaatgacttcactcgggttgttggtgga gaagatgccaaaccaggtcaattcccttggcaggt tgtttgaatggtaaagttgatgcattctgtggaggct ctatcgttaatgaaaaatggattgtaactgctgccca ctgtgttgaaactggtgttaaaattacagttgtcgca ggtgaacataatattgaggagacagaacatacaga gcaaaagcgaaatgtgattcgaattattcctcacca caactacaatgcagctattaataagtacaaccatga cattgcccttctggaactggacgaacccttagtgct aaacagctacgttacacctatttgcattgctgacaag gaatacacgaacatcttcctcaaatttggatctggct atgtaagtggctggggaagagtGttccacaaagg gagatcagctttagttcttcagtaccttagagttccac ttgttgaccgagccacatgtctAcgatctacaaagt tcaccatctataacaacatgttctgtgctggcttccat gaaggaggtagagattcatgtcaaggagatagtg ggggacccatgttactgaagtggaagggaccag tttcttaactggaattattagctggggtgaagagtgt gcaatgaaaggcaaatatggaatatataccaaggt atcccggtatgtcaactggattaaggaaaaaacaa agctcactGGCCCAGAAcaaacAtctaag ctAacGcgtgcGgagacAgtAtttccaGGT TCTCCAGCCGGGTCCCCAACTT CGACCGAGGAAGGGACCTCCG AGTCAGCTACCCCGGAGTCCGG TCCTGGCACCTCCACCGAACCA | 619 |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | PGTSESATPESGPGTSES | | TCGGAGGGCAGCGCCCCTGGG | |
| | ATPESGPGSPAGSPTST | | AGCCCTGCCGGGAGCCCTACA | |
| | EEGTSESATPESGPGSEP | | AGCACCGAAGAGGGCACCAGT | |
| | ATSGSETPGTSESATPES | | ACAGAGCCAAGTGAGGGGAGC | |
| | GPGTSTEPSEGSAPGTS | | GCCCCTGGTACTAGTACTGAAC | |
| | TEPSEGSAPGTSTEPSEG | | CATCCGAGGGGTCAGCTCCAG | |
| | SAPGTSTEPSEGSAPGT | | GCACGAGTGAGTCCGCTACCCC | |
| | STEPSEGSAPGTSTEPSE | | CGAGAGCGGACCGGGCTCAGA | |
| | GSAPGSPAGSPTSTEEG | | GCCCGCCACGAGTGGCAGTGA | |
| | TSTEPSEGSAPGTSESAT | | AACTCCAGGCTCAGAACCCGCC | |
| | PESGPGSEPATSGSETP | | ACTAGTGGGTCAGAGACTCCA | |
| | GTSESATPESGPGSEPA | | GGCAGCCCTGCCGGATCCCCTA | |
| | TSGSETPGTSESATPESG | | CGTCCACCGAGGAGGGAACAT | |
| | PGTSTEPSEGSAPGTSES | | CTGAGTCCGCAACACCCGAATC | |
| | ATPESGPGSPAGSPTST | | CGGTCCAGGCACCTCCACGGA | |
| | EEGSPAGSPTSTEEGSP | | ACCTAGTGAAGGCTCGGCACC | |
| | AGSPTSTEEGTSESATP | | AGGTACAAGCACCGAACCTAG | |
| | ESGPGTSTEPSEGSAPG | | CGAGGGCAGCGCTCCCGGCAG | |
| | TSESATPESGPGSEPATS | | CCCTGCCGGCAGCCCAACCTCA | |
| | GSETPGTSESATPESGP | | ACTGAGGAGGGCACCAGTACT | |
| | GSEPATSGSETPGTSES | | GAGCCCAGCGAGGGATCAGCA | |
| | ATPESGPGTSTEPSEGS | | CCTGGCACCAGCACCGAACCTA | |
| | APGSPAGSPTSTEEGTS | | GCGAGGGGAGCGCCCCTGGGA | |
| | ESATPESGPGSEPATSG | | CTAGCGAGTCAGCTACACCAG | |
| | SETPGTSESATPESGPGS | | AGAGCGGGCCTGGAACTTCTAC | |
| | PAGSPTSTEEGSPAGSP | | CGAACCCAGTGAGGGATCCGC | |
| | TSTEEGTSTEPSEGSAP | | TCCAGGCACCTCCGAATCCGCA | |
| | GTSESATPESGPGTSES | | ACCCCGAATCCGGACCTGGCT | |
| | ATPESGPGTSESATPES | | CAGAGCCCGCCACCAGCGGGA | |
| | GPGSEPATSGSETPGSE | | GCGAAACCCCTGGCACATCCAC | |
| | PATSGSETPGSPAGSPTS | | CGAGCCTAGCGAAGGGTCCGC | |
| | TEEGTSTEPSEGSAPGT | | ACCCGGCACCAGTACAGAGCC | |
| | STEPSEGSAPGSEPATS | | TAGCGAGGGATCAGCACCTGG | |
| | GSETPGTSESATPESGP | | CACCAGTGAATCTGCTACACCA | |
| | GTSTEPSEGSAPGSSS | | GAGAGCGGGCCTGGAACCTCC | |
| | | | GAGTCCGCTACCCCCGAGAGC | |
| | | | GGGCCAGGTTCTCCTGCTGGCT | |
| | | | CCCCCACCTCAACAGAAGAGG | |
| | | | GGACAAGCGAAAGCGCTACGC | |
| | | | CTGAGAGTGGCCCTGGCTCTGA | |
| | | | GCCAGCCACCTCCGGCTCTGAA | |
| | | | ACCCCTGGCACTAGTGAGTCTG | |
| | | | CCACGCCTGAGTCCGGACCCGG | |
| | | | GACCTCTACTGAGCCCTCGGAG | |
| | | | GGGAGCGCTCCTGGCACGAGT | |
| | | | ACAGAACCTTCCGAAGGAAGT | |
| | | | GCACCGGGCACAAGCACCGAG | |
| | | | CCTTCCGAAGGCTCTGCTCCCG | |
| | | | GAACCTCTACCGAACCCTCTGA | |
| | | | AGGGTCTGCACCCGGCACGAG | |
| | | | CACCGAACCCAGCGAAGGGTC | |
| | | | AGCGCCTGGGACCTCAACAGA | |
| | | | GCCCTCGGAAGGATCAGCGCCT | |
| | | | GGAAGCCCTGCAGGGAGTCCA | |
| | | | ACTTCCACGGAAGAAGGAACG | |
| | | | TCTACAGAGCCATCAGAGGGG | |
| | | | TCCGCACCAGGTACCAGCGAAT | |
| | | | CCGCTACTCCCGAATCTGGCCC | |
| | | | TGGGTCCGAACCTGCCACCTCC | |
| | | | GGCTCTGAAACTCCAGGGACCT | |
| | | | CCGAATCTGCCACACCCGAGA | |
| | | | GCGGCCCTGGCTCCGAGCCCGC | |
| | | | AACATCTGGCAGCGAGACACC | |
| | | | TGGCACCTCCGAGAGCGCAAC | |
| | | | ACCCGAGAGCGGGCCCTGGCAC | |
| | | | CAGCACCGAGCCATCCGAGGG | |
| | | | ATCCGCCCCAGGCACTTCTGAG | |
| | | | TCAGCCACACCCGAAAGCGGA | |
| | | | CCAGGATCACCCGCTGGCTCCC | |
| | | | CCACCAGTACCGAGGAGGGGT | |
| | | | CCCCCGCTGGAAGTCCAACAA | |
| | | | GCACTGAGGAAGGGTCCCCTG | |
| | | | CCGGCTCCCCCACAAGTACCGA | |
| | | | AGAGGGCACAAGTGAGAGCGC | |

TABLE 25-continued

FIX-XTEN with cleavage sequence: amino acid and nucleic acid sequences

| Name | Amino Acid Sequence | SEQ ID NO: | Nucleic Acid Sequences | SEQ ID NO: |
|---|---|---|---|---|
| | | | CACTCCCGAGTCCGGGCCTGGC ACCAGCACAGAGCCTTCCGAG GGGTCCGCACCAGGTACCTCAG AGTCTGCTACCCCCGAGTCAGG GCCAGGATCAGAGCCAGCCAC CTCCGGGTCTGAGACACCCGGG ACTTCCGAGAGTGCCACCCCTG AGTCCGGACCCGGGTCCGAGC CCGCCACTTCCGGCTCCGAAAC TCCCGGCACAAGCGAGAGCGC TACCCCAGAGTCAGGACCAGG AACATCTACAGAGCCCTCTGAA GGCTCCGCTCCAGGGTCCCCAG CCGGCAGTCCCACTAGCACCGA GGAGGGAACCTCTGAAAGCGC CACACCCGAATCAGGGCCAGG GTCTGAGCCTGCTACCAGCGGC AGCGAGACACCAGGCACCTCT GAGTCCGCCACACCAGAGTCC GGACCCGGATCTCCCGCTGGGA GCCCCACCTCCACTGAGGAGG GATCTCCTGCTGGCTCTCCAAC ATCTACTGAGGAAGGTACCTCA ACCGAGCCATCCGAGGGATCA GCTCCCGGCACCTCAGAGTCGG CAACCCCGGAGTCTGGACCCG GAACTTCCGAAAGTGCCACACC AGAGTCCGGTCCCGGGACTTCA GAATCAGCAACACCCGAGTCC GGCCCTGGGTCTGAACCCGCCA CAAGTGGTAGTGAGACACCAG GATCAGAACCTGCTACCTCAGG GTCAGAGACACCCGGATCTCCG GCAGGCTCACCAACCTCCACTG AGGAGGGCACCAGCACAGAAC CAAGCGAGGGCTCCGCACCCG GAACAAGCACTGAACCCAGTG AGGGTTCAGCACCCGGCTCTGA GCCGGCCACAAGTGGCAGTGA GACACCCGGCACTTCAGAGAG TGCCACCCCCGAGAGTGGCCCA GGCACTAGTACCGAGCCCTCTG AAGGCAGTGCGCCAGGTTCGTC TTCATAA | |

Example 25

Expression of FVII-XTEN and FIX-XTEN

Transient Transfection of Mammalian Cells

Mammalian cells, including CHO-K1, BHK, COS-7, and HEK293, were found to express FVII-XTEN or FIX-XTEN using different XTEN lengths when transfected. The following are details for methods used to express the various FVII-XTEN and FIX-XTEN fusion protein constructs by transient transfection.

HEK293 cells were plated the day before transfection, $1 \times 10^5$ per well in 12-well plate in 1 ml medium containing 10% FBS, 1× Pen/Strep, and 5 mg/ml vitamin K. For transfection the day after plating the cells, plasmid DNA (0.6 µg) diluted in OptiMEM (total 25 µl) was mixed with diluted FuGENE6 (2.1 µl FuGENE6 in 22.9 µl OptiMEM) and incubated for 30 min at room temperature before adding to the cells. On day 3 or 4 after transfection the culture medium was collected, centrifuged at 500×g for 5 min at room temperature, and then the supernatant filtered using 0.2 µm filter before testing for expression of FVII-XTEN or FIX-XTEN in ELISA and performance in a clotting assay (PT for FVII activity and aPTT for FIX activity). The results are presented in Table 26.

It should be noted that the titer measured for FVII-XTEN by PT assay (active FVII protein) was higher than the titer measured by ELISA (total FVII protein), and while the exact cause for this remained to be clarified, it could be due to (1) underestimation of FVII in the context of FVII-XTEN due to epitope shielding by XTEN, (2) overestimation of clotting activity by the PT assay, or a combination of both (1) and (2). It should also be noted that the titer measured for FIX by aPTT assay (active FIX protein) was significantly lower than the titer measured by ELISA (total FIX protein), only about 20%, due to unknown reasons, but one of which could be insufficient propeptide processing, a phenomenon that has been reported for recombinant FIX produced in CHO or other mammalian cells. The titer of FIX-XTEN by aPTT was even lower proportionally than ELISA compared to FIX alone, suggesting the activity of FIX could be reduced by fusing to XTEN, an assumption confirmed by analyzing the activity and ELISA titers of protein after TEV treatment for materials produced from cells transfected with plasmids constructs encoding a FVII-XTEN but with TEV cleavage site inserted in between.

TABLE 26

Expression of FVII, FVII-XTEN_AE864, FIX, and FIX-XTEN_AE864

|  | FVII | | FVII-XTEN | | FIX | | FIX-XTEN | |
| --- | --- | --- | --- | --- | --- | --- | --- | --- |
|  | ELISA | Clotting | ELISA | Clotting | ELISA | Clotting | ELISA | Clotting |
| ng/ml | 391.0 | 397.7 | 34.8 | 176.6 | 309.8 | 60.0 | 13.7 | 0.4 |

Generation of CHO-K1 Stable Pools and Cell Lines that Produce FVII-XTEN

Cells:

CHO-K1 cells purchased from ATCC (Cat. CCL-61, Lot 58078551) were revived in Complete Medium (F-12K, 10% FBS and 1× P/S, Appendix 1) and passaged for four generations before multiple vials were frozen in the Complete Medium with 5% DMSO. One vial was revived in medium similar to the Complete Medium but with 5% FBS and passaged one more time before transfection.

Generation of Stable Pool:

Construction of plasmids pBC0014, pBC0016, and pBC0018 encoding FVII-AE864, FVII-AE864, and FVII-AE288, respectively, has been described in the Examples above. Two of the plasmids pBC0016 and pBC0018 also carry UCOE. The plasmids were first linearized with PvuII and then transfected with FuGENE6 transfection reagent into separate T25 flasks of CHO-K1 cells from above, 3.6 μg plasmid DNA for $6.5 \times 10^5$ cells per flask. Two days later the cells were transferred to T75 and cultured in Selection Medium (Complete Medium with 10 μg/ml puromycin and 5 μg/ml vitamin K). The flasks were changed to fresh Selection Medium every 2-3 days. Two weeks after transfection, cells from T75 flasks were frozen as stable pool.

Figure 9:
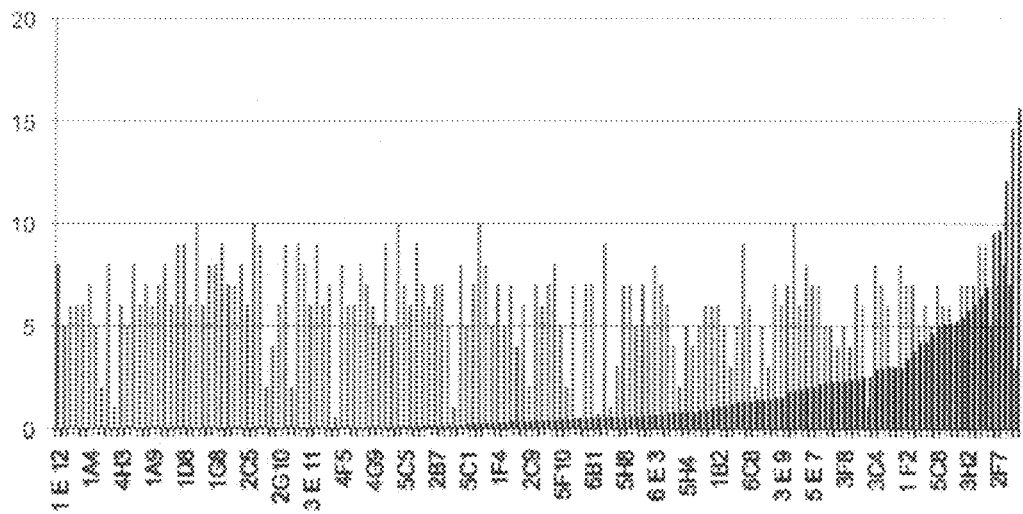
FIG. 9 is a graph of the distribution of cell cluster size (gray bars) and FVII ELISA titers in ng/ml (black bars) by ELISA of clones from primary screening of pBC0014 CHO-K1 transformants (not all clones were labeled underneath the bars due to insufficient space)(see Example 25 for experimental details). Clones were sorted according to ELISA titer low to high (left to right).

Selection of Clones:

For primary screening, frozen stable pool cells were revived and seeded in 6 96-well plates at a target density of 0.5 cell/well. About 1 week after seeding spent medium from wells with single cell cluster as observed under microscope were tested for expression of FVII by ELISA. The number of clones tested in the primary screening by the ELISA was: 154 for pBC0014, 210 for pBC0016, and 135 for pBC0018. Significant numbers of clones expressed no or non-detectable levels of FVII (FIG. 9, black bars, expressed as ng/ml), but 15-20% of the clones expressed FVII of 3-8 fold higher, these clones were then selected for further screening and selection, 20 for pBC0014, 30 for pBC0016, and 20 for pBC0018. The size of the cell clusters in these wells was scored 1-10 with 1 being the smallest cluster and 10 the largest cluster; the results are shown as gray bars in FIG. 9. The distribution of the cell cluster size of these clones was similar to that of all the clones for the same variant, suggesting they were selected not just because they were the fastest growers.

Figure 10:
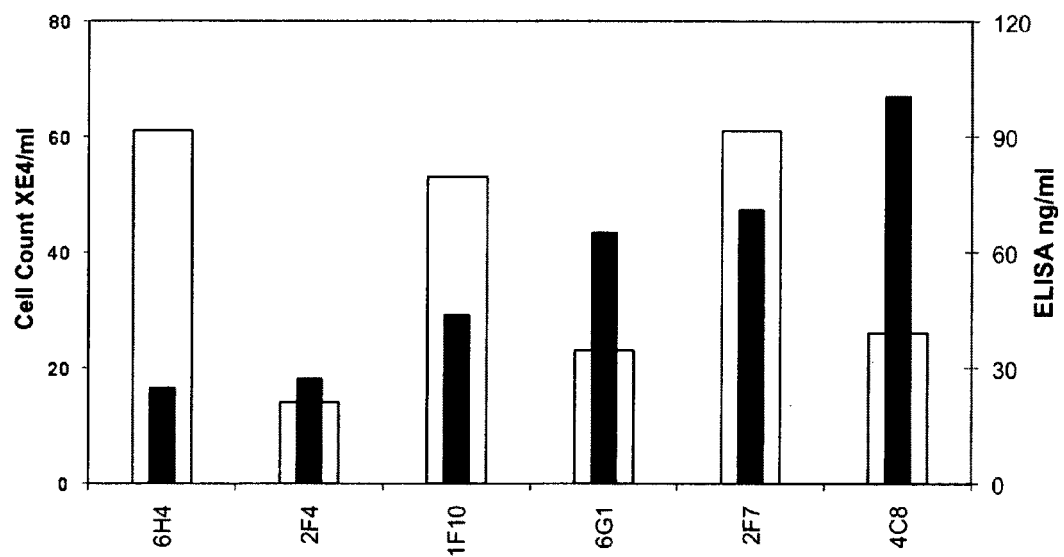
FIG. 10 is a graph of cell counts (white bars) and FVII titers in ng/ml (black bars) of the top pBC0014 clones (see Example 25 for experimental details). Clones were sorted according to ELISA titer, low to high (left to right).
Figure 11:
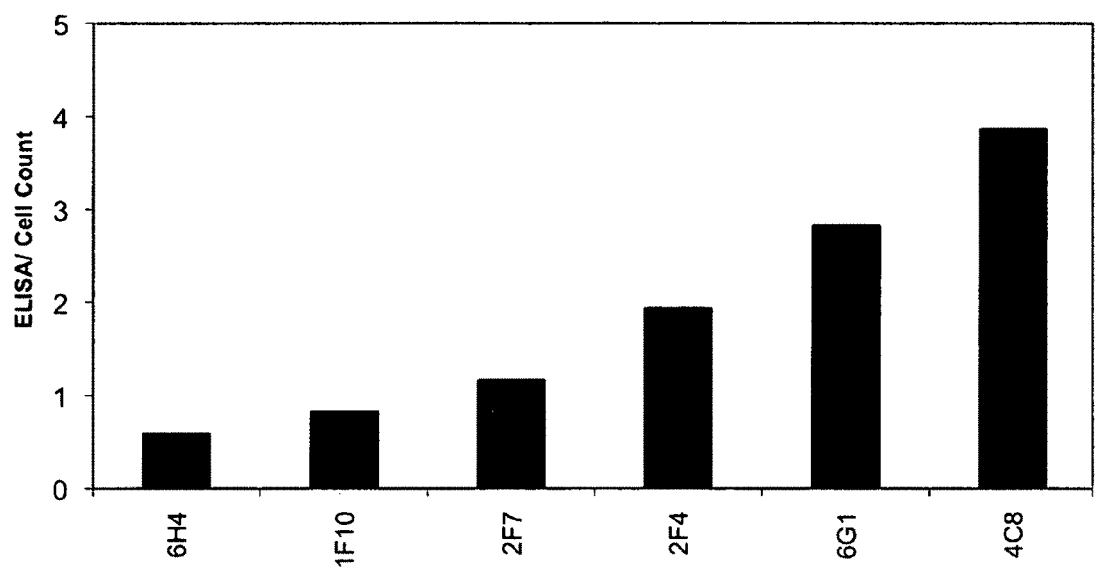
FIG. 11 is a graph of the ratio of FVII titer over cell count of the top pBC0014 clones (see Example 25 for experimental details). Clones were sorted according to the ratio, low to high (left to right).
Figure 12:
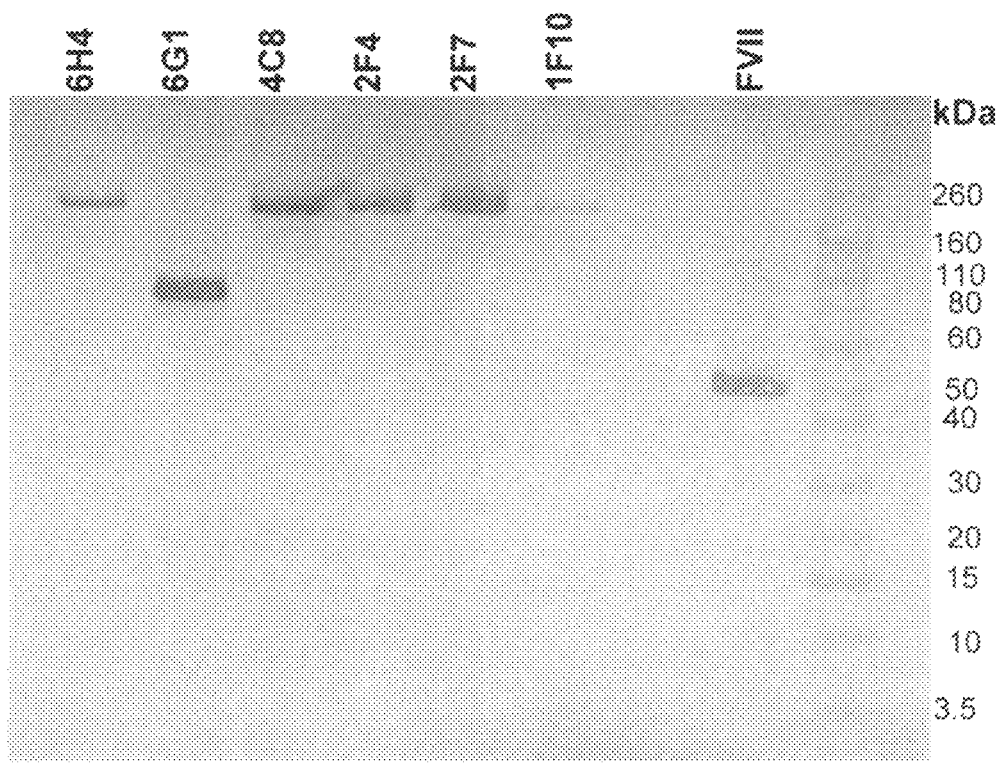
FIG. 12 is a Western blot of top pBC0014 clones according to ELISA, clotting, ELISA/cell count and clotting/cell count ratios (see Example 25 for experimental details). Clone 6G1 expressed a truncated product and was not evaluated further.
Figure 13:
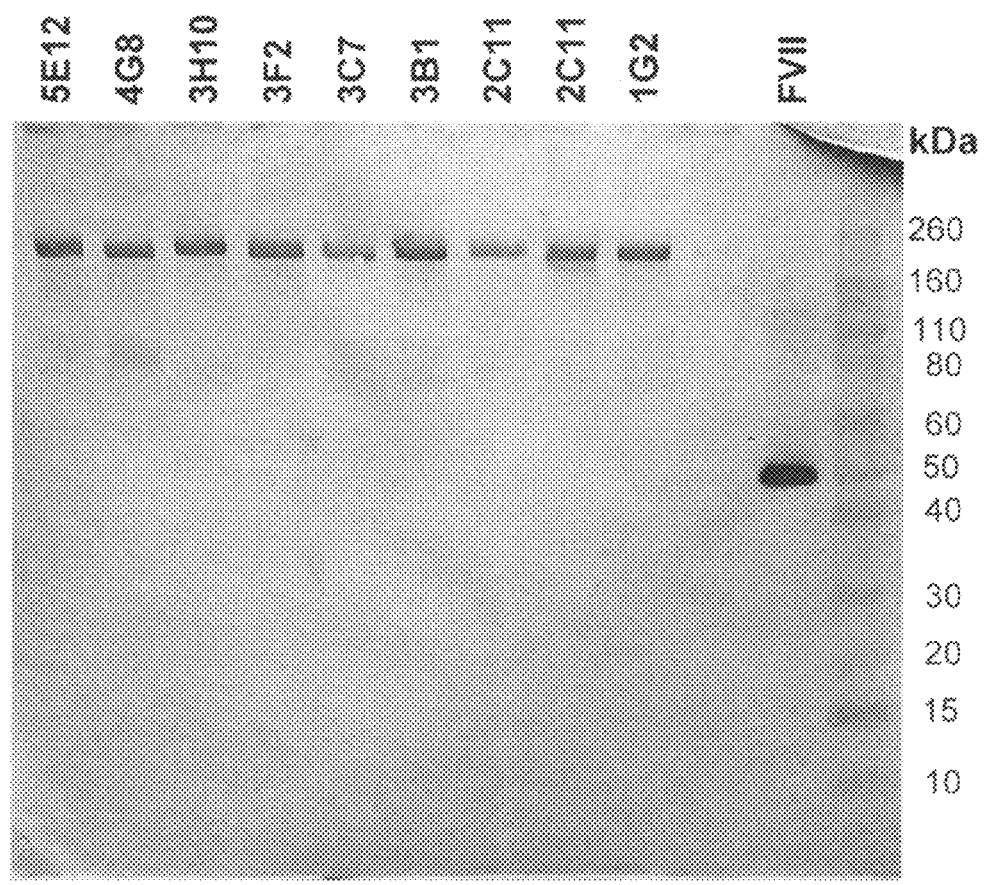
FIG. 13 is a Western blot of the top pBC0016 clones according to ELISA, clotting, ELISA/cell count and clotting/cell count ratios (see Example 25 for experimental details).
Figure 14:
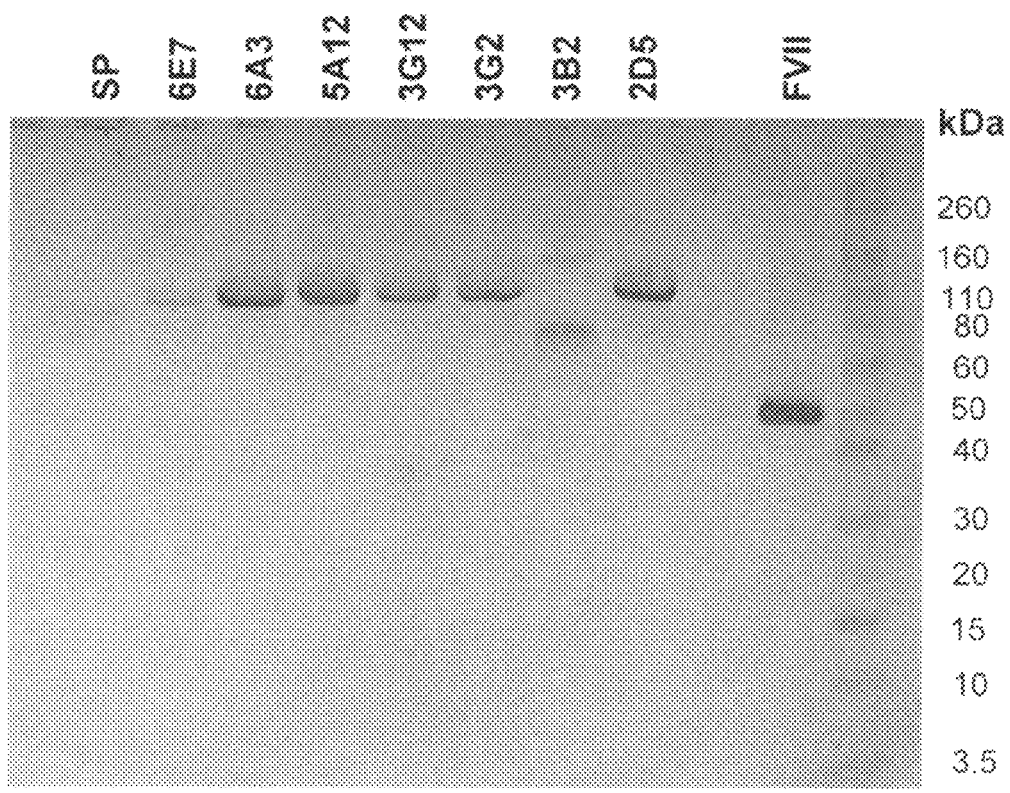
FIG. 14 is a Western blot of the top pBC0018 clones according to ELISA, clotting, ELISA/cell count and clotting/cell count ratios (see Example 25 for experimental details). Clone 3B2 expressed a truncated product and was not evaluated further.

For additional rounds of screening, normalized numbers of cells were seeded in multi-well plates. Spent medium were harvested 2-3 days after seeding and were tested for FVII concentration by ELISA and clotting activity by PT; Cells were also harvested from the plates and counted using Vi-Cell. Clones were ranked by (1) FVII titers according to ELISA and clotting; (2) Ratios of ELISA titer/cell count and clotting titer/cell count; and (3) Integrity and homogeneity of products produced by the clones as measured by Western blots. Selection of clones for each of the construct pBC0014, pBC0016, and pBC0018 was described separately in the following.

pBC0014:

For the second round of screening, cells in 96-well plates for the top 20 clones selected from primary screening were first expanded in T25 flasks and then seeded in duplicate 24-well plates, one cultured for 2 days and the other one for 3 days. Spent medium were collected from the plates for FVII ELISA and cells harvested and counted by Vi-Cell. Fourteen clones were selected according to titers by ELISA and clotting, ELISA titer/cell and clotting titer/cell count ratios and further screened. Frozen vials were prepared for 9 clones, 1F10, 2F7, 6H4, 1A3, 6F10, 5C2, 5F1, 3H2, 4C8. Out of the 14 clones, 1F10, 1F4, 2F7, 4C8, 6H4, and 6G1 were again screened and ranked according to titers by ELISA and clotting, ratios of ELISA titer/cell count and clotting titer/cell count, and product integrity and homogeneity by Western blot (FIGS. 10-12). Clone 6G1 expressed a product that is significantly smaller than the full-length product (FIG. 12) and was discarded. Additional frozen vials were prepared for clones 1F10, 2F7, 6H4, and 4C8. Clone 4C8 was tested for production of FVII-AE864 in roller bottles.

pBC0016:

For the second round of screening, cells in 96-well plates for the top 30 clones selected from primary screening were transferred to 12-well plates and then T25 and ranked by titers according to ELISA and clotting assays, ratios of ELISA titer/cell count and clotting titer/cell count. For the third round of screening, fifteen clones including 1D4, 1G2, 1G6, 2C11, 2H6, 3A2, 3B1, 3C7, 3F2, 3H1, 3H6, 3H10, 4G8, 5E12, 6F11 were tested, ranked according to above criteria plus Western blot (FIG. 13) and frozen cells were prepared for all of the 15 clones, except 3H6. Eight clones including 1G2, 2C11, 3B1, 3C7, 3F2, 3H10, 4G8, 5E12 were selected as the top clones and additional frozen vials were prepared for them. Clone 3H10 was selected for scale-up production in roller bottles.

pBC0018:

For the second round of screening, cells in 96-well plates for the top 20 clones selected from primary screening were first expanded in T25 flasks and then seeded in 24-well plates. Spent medium were collected from the plates for FVII ELISA and cells harvested and counted by Vi-Cell. Twelve clones were selected according to titers by ELISA and clotting, ELISA titer/cell and clotting titer/cell count ratios and further screened. Frozen vials were prepared for 9 clones, 2C3, 2D5, 3B2, 3B10, 3G2, 3G12, 5A12, 6A3, and 6E7. Out of the 9 clones, 2D5, 3B2, 3G2, 3G12, 5A3, and 6E7 were again screened and ranked according to titers by ELISA and clotting, ratios of ELISA titer/cell count and clotting titer/cell count, and product integrity and homogeneity by Western blot (FIG. 14). Clone 3B2 expressed products that displayed multiple bands on Western blot and it was discarded. Additional frozen vials were prepared for clones 2D5, 3G2, 3G12, 5A12, 6A3, 6E7. Clones 3G12 and 6E7 were used for production of FVII-AE288 in roller bottles.

Production of FVII-XTEN Secreted in Cell Culture Medium in Roller Bottles

CHO-K1 cell stable pools or clones were expanded in T175, 35 ml Selection Medium per flask. Cells were harvested from by trypsinization and used to seed roller bottles (1700 cm² surface area per bottle) on Day 0, 300 ml Selection Medium with cells from 1-2 T175 flasks for every roller bottle. The spent/conditioned medium was removed on Day 3 (or 4) and refilled with 300 ml fresh Selection Medium. On Day 5 (or 6) the spent/conditioned medium was removed and discarded (or harvested if XTEN fusion proteins in this medium can be purified) and 300 ml Transition Medium (UltraCHO containing 1% FBS, 0.1% Ex-Cyte, 5 mg/ml vitamin K, and 1× Pen/Step) was added to each roller bottle. On Day 7 (or 8) the spent medium was removed and discarded (or harvested if XTEN fusion proteins can be purified from this medium) and Expression Medium (OptiMEM containing 0.1% Ex-Cyte, 1% ITS-A, 5 mg/ml vitamin K, and 1× Pen/Strep) was added, 300 ml per bottle or other volumes depending on results from optimization. Conditioned medium could be harvested once everyday, or once every 2, or 3, or 4 days depending on product titer and quality desired. To harvest, the conditioned medium was poured into centrifuge bottles, and fresh Expression Medium was added, 300 ml per bottle or other volumes depending on results from optimization. This production of harvesting spent medium and refilling with fresh medium could last for 2-4 weeks until titer or/and product quality are considered too low, when the roller bottles are terminated. The conditioned medium was then centrifuged, 3500 rpm in a bench-top centrifuge, for 10 min, at 4-8° C. The supernatant was then filtered using a 0.2 mm filter. The filtrate was either processed immediately or was stored in −80° C. freezer before processing by tangential flow filtration (TFF) for purification.

Example 26

Purification and Characterization of FVII-XTEN Constructs

Concentration and Buffer Exchange of FVII-XTEN_AE864 by Tangential Flow Filtration and Diafiltration Supernatant batches S279, S281, S282 and S287, totaling 10.7 L in volume, from stable CHO cells lines expressing FVII-AE864 (AC404) were filtered using a Cuno ZetaPlus Biocap filter and a Cuno BioAssure capsule. They were subsequently concentrated approximately 20 fold by tangential flow filtration using a Millipore Pellicon 2 Mini cartridge with a 30,000 Da MWCO. Using the same tangential flow filtration cartridge the sample was diafiltered with 10 mM tris pH 7.5, 1 mM EDTA with 5 volumes worth of buffer exchange. Samples were divided into 50 ml aliquots and frozen at −80° C. No FVII activity was detectable in the permeate fractions from the filtration and ~75% recovery of the activity was seen in the concentrated, buffer exchanged material.

Purification of FVII-XTEN_AE864 by BaSO₄ Adsorption

FVII-AE864 (AC404) containing supernatant was concentrated and buffer exchanged into 10 mM tris pH 7.5, 1 mM EDTA. Subsequently, 5 ml of this sample was diluted 10 fold in PBS, additional NaCl was added to 50 mM, and then BaSO₄ was added to 20 mg/ml. The sample was bound on a nutator at room temperature for 30 minutes. The sample was then centrifuged at 3000 rpm for 5 minutes to pellet the BaSO₄. The supernatant was discarded and the pellet resuspended in 5 ml if 200 mM sodium acetate and nutated for 30 minutes at room temperature. This was repeated two more times. After the third wash the pellet was resuspended in 0.8 ml of 100 mM trisodium citrate pH 7.0 and nutated for 30 minutes at room temperature. This was repeated once. A Bradford assay was performed to determine the total amount of protein in the sample and FVII activity was assayed in a PT based factor assay with Innovin as the activating thromboplastin (Table 27). The ratio of activity to total protein demonstrated a net purification of ~12 fold from this purification step.

TABLE 27

Purification Table of FVII-AE864 by BaSO4 Absorption

| Fraction | Volume (ml) | Total Activity (U) | Total Protein (ug) | Specific Activity | Purification | Purity (%) |
|---|---|---|---|---|---|---|
| Feed | 5 | 17.3 | 6300 | 0.003 | 1.0 | 0.1% |
| FT 1 | 5 | 4.0 | 4687 | 0.001 | 0.3 | 0.0% |
| Wash 1 | 5 | NA | 57 | NA | NA | NA |
| Wash 2 | 5 | NA | 8 | NA | NA | NA |
| Wash 3 | 5 | NA | 8 | NA | NA | NA |
| Elution 1 | 0.8 | 3.2 | 85 | 0.038 | 13.8 | 1.9% |
| Elution 2 | 0.8 | 0.4 | 12 | 0.030 | 11.0 | 1.5% |

Purification of FVII-XTEN_AE864 by aGla Affinity Chromatography

Figure 15:
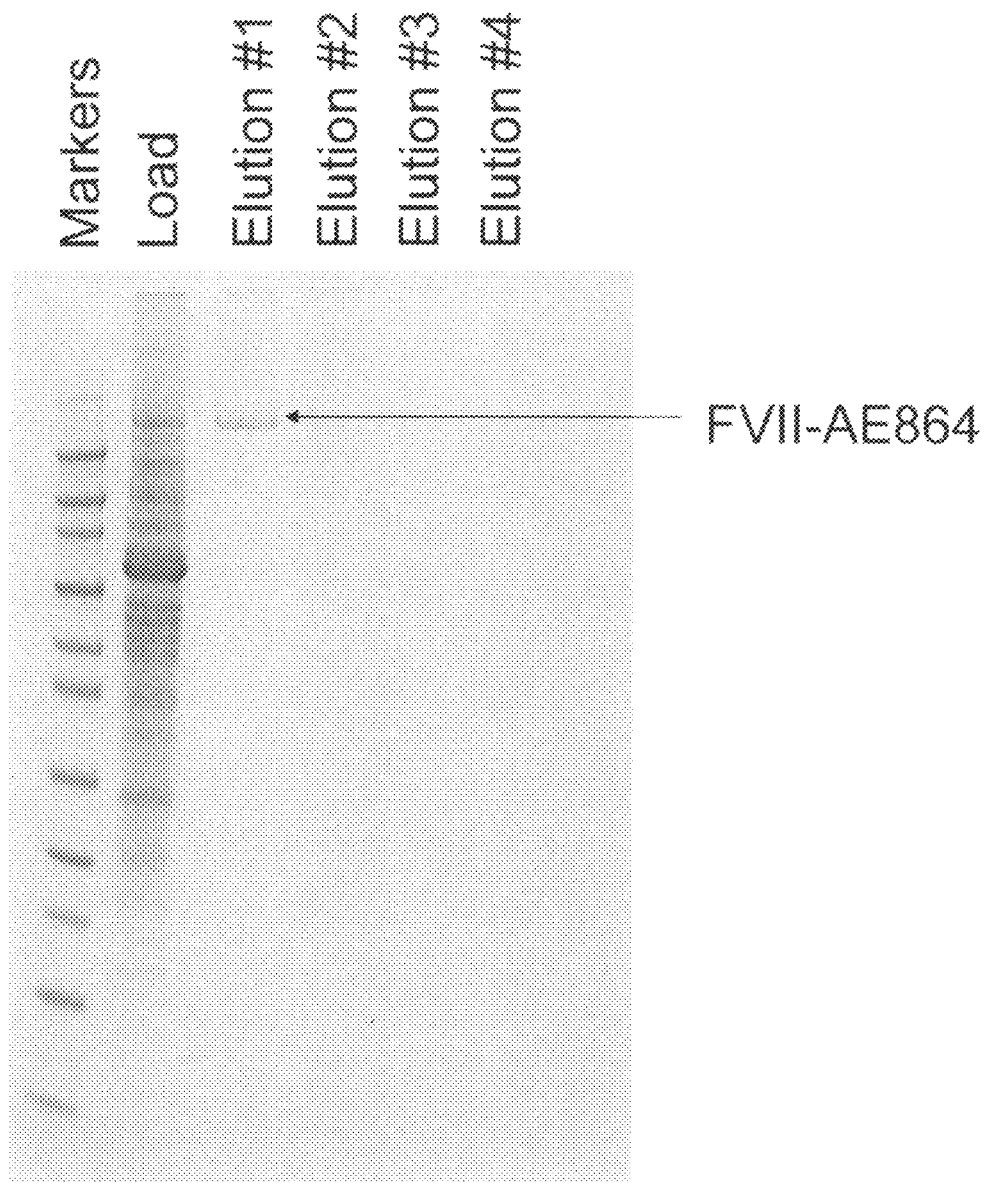
FIG. 15 shows purification of FVII-AE864 by anti-GLA affinity chromatography (see Example 26 for experimental details). SDS-PAGE analysis demonstrating the purification of FVII-AE864 from concentrated supernatant and the >90% purity of the EDTA eluted fractions.

A monoclonal antibody (clone ID CaFVII-22) which binds the GLA domain of FVII in a calcium dependent manner was coupled to Ultralink beads from Pierce. Coupling was performed by adding 10 mg of antibody in PBS to 1.25 of resin and bringing the final volume to 15 ml with coupling buffer (100 mM MOPS, 700 mM sodium citrate, pH 8.0). This produced 10 ml of resin slurry and a 1 mg to 1 ml ratio of antibody mass to bead slurry volume. The slurry was incubated for 2 hours at room temperature and then the beads were washed with coupling buffer. A BCA assay indicated ~70% of the antibody was coupled to the beads. The beads are then quenched with 1M tris pH 8.0 for 2 hours at room temperature. The beads were equilibrated into 10 mM tris pH 7.5 and 10 mM CaCl2 and 5.5 ml of beads was mixed with 50 ml of concentrated, buffer exchanged FVII-AE864 (AC404) supernatant in 10 mM tris pH 7.5 and ~10 mM CaCl2. The sample was incubated at 4° C. overnight on a nutator to bind the FVII-XTEN to the resin. The following day the beads were washed three times with 45 ml 10 mM tris, 500 mM NaCl, 10 mM CaCl2, pH 7.5 and then eluted with 20 ml of 10 mM tris, 100 mM EDTA, pH 7.5. SDS-PAGE analysis indicates that the purity is in excess of 90% (FIG. 15).

Activation of FVII-XTEN_AE864 and FVII-XTEN_AE288

Figure 16:
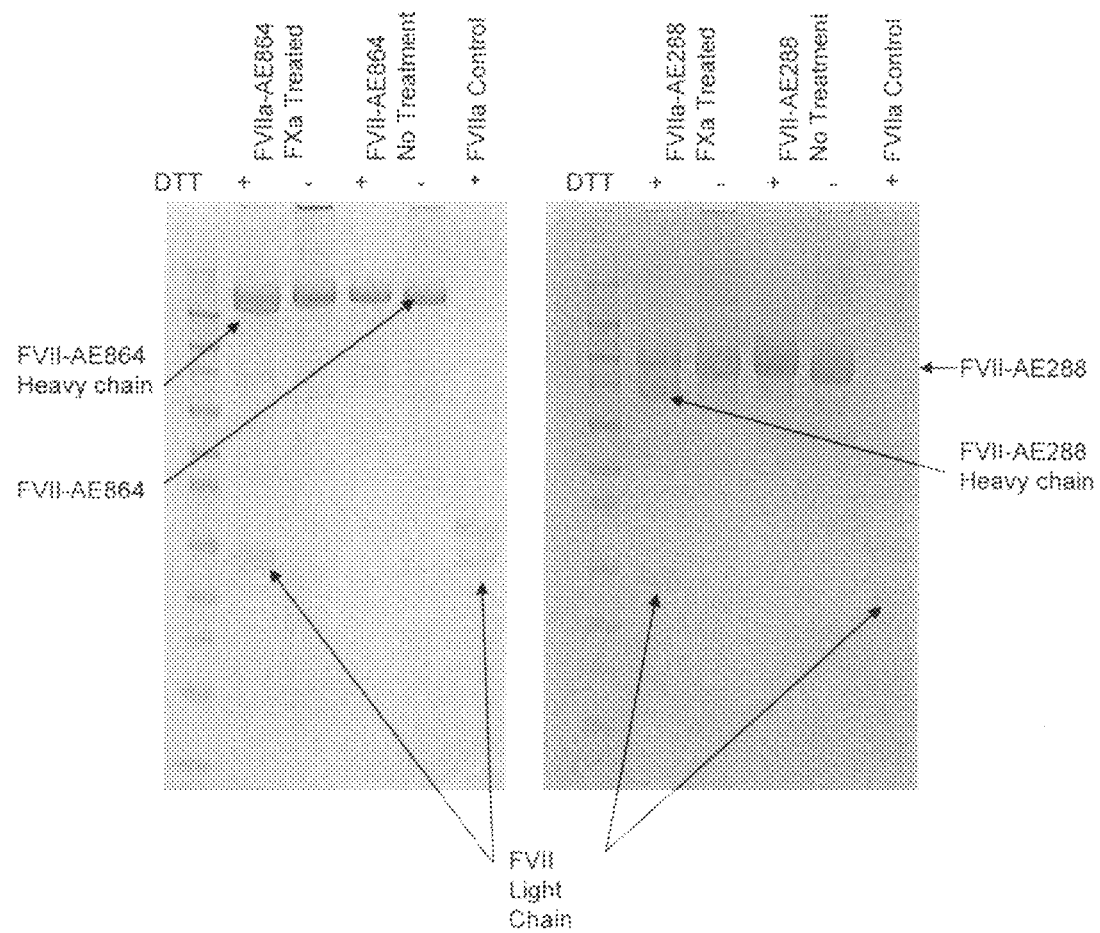
FIG. 16 shows activation of FVII-XTEN fusions to FVIIa-XTEN fusions by FXa treatment (see Example 26 for experimental details). SDS-PAGE analysis demonstrates the appearance of a light chain band under reducing conditions after FXa treatment, but not in the untreated sample. Additionally, there is a downwards shift in the upper band indicating the loss of the light chain.

Affinity purified FVII-AE864 (AC404) and FVII-AE288 (AC398) were activated to FVIIa-AE864 and FVIIa-AE288 by addition of FXa. The FVII-XTEN proteins were buffer exchanged into 10 mM Tris, 10 mM CaCl2, pH7.5 via repeat rounds of concentration in an Amicon ultra 10,000 Da MWCO concentrator and subsequent dilution. The final volume was 1 ml at ~0.4 mg/ml. FXa from Novagen was added to a final concentration of 10 units/ml and the sample incubated overnight at 4° C. Reducing SDS-PAGE indicated a complete conversion of FVII-XTEN proteins to FVIIa-XTEN proteins by the downward shift in the top band with DTT compared to the non-reduced sample which represents the loss of the light chain from the molecule, which can only occur upon activation (FIG. 16). Additionally, the light chain can be seen appearing lower on the gel and running at the same position as the light chain of control FVIIa, further confirming the transition of the FVII domain from FVII to FVIIa. Under similar buffer conditions FVII-XTEN fusions are activated to FVIIa-XTEN by the addition of thrombin, FIXa, FXIIa or any other protease capable of selectively cutting the peptide bond between R152 and I153.

Autoactivation of FVII-XTEN_AE864 and FVII-XTEN_AE288

Figure 17:
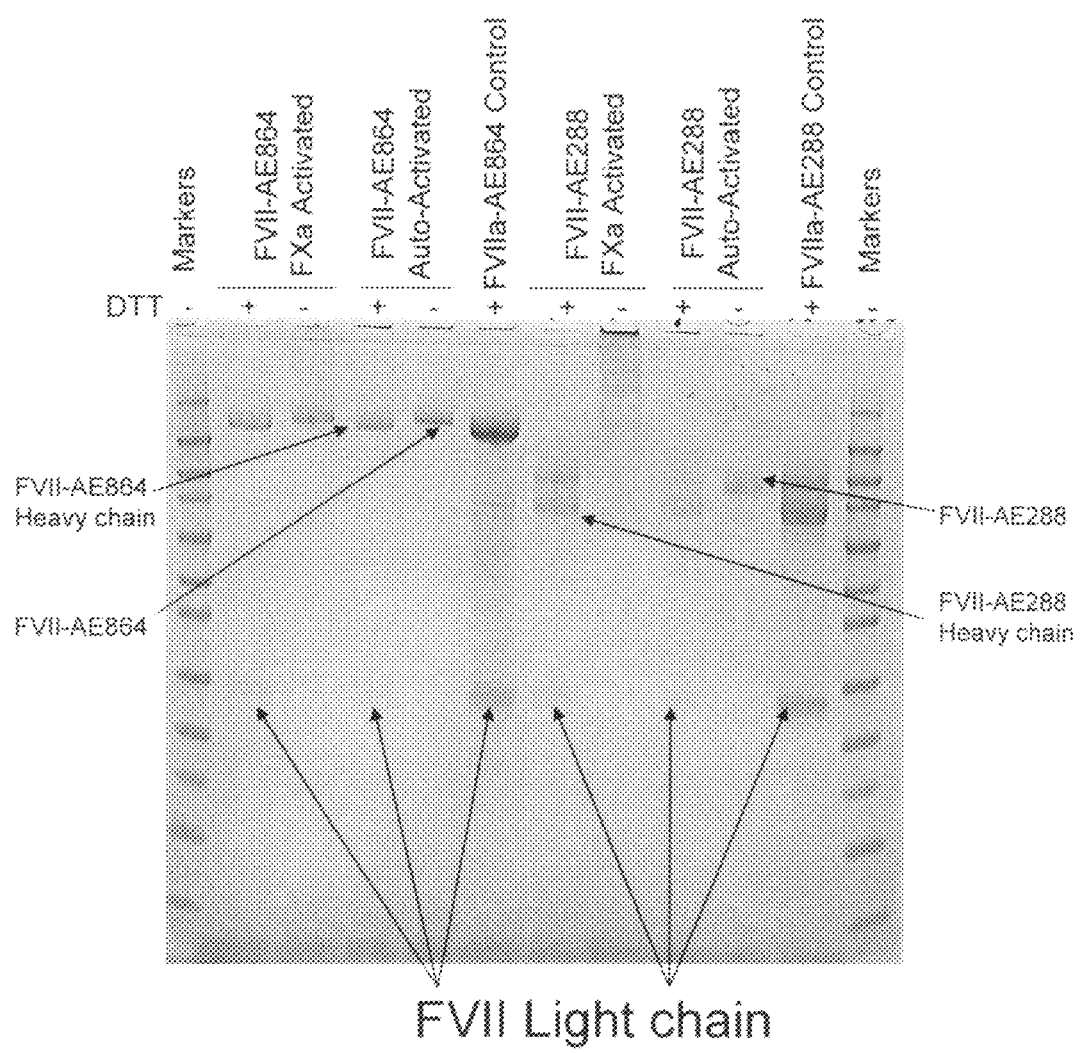
FIG. 17 shows an SDS-PAGE demonstrating auto-activation of FVII-XTEN fusions to FVIIa-XTEN fusions (see Example 26 for experimental details). SDS-PAGE analysis demonstrating appearance of a light chain band under reducing conditions after FXa treatment and after incubation at 4° C. at high concentration with $CaCl_2$. Additionally, there is a downwards shift in the upper band indicating the loss of the light chain.

Affinity purified FVII-AE864 (AC404) and FVII-AE288 (AC398) were activated to FVIIa-AE864 and FVIIa-AE288 by incubating the sample at 4° C. for 1 week. The FVII-XTEN proteins were buffer exchanged into 10 mM Tris, 10 mM CaCl2, pH7.5 via repeat rounds of concentration in an Amicon ultra 10,000 Da MWCO concentrator and subsequent dilution. After the incubation the protein was assayed by SDS-PAGE and the top band displays the characteristic downward shift in the top band with DTT compared to the non-reduced sample which represents the loss of the light chain from the molecule, which can only occur upon activation (FIG. 17). Additionally, the light chain can bee seen appearing lower on the gel at the same point as the two lots of FXa activated material, further corroborating the conclusion that the proteins auto-activated to FVIIa-XTEN.

Purification of FVII-XTEN_AE864 by Anion Exchange Chromatography

Figure 19:
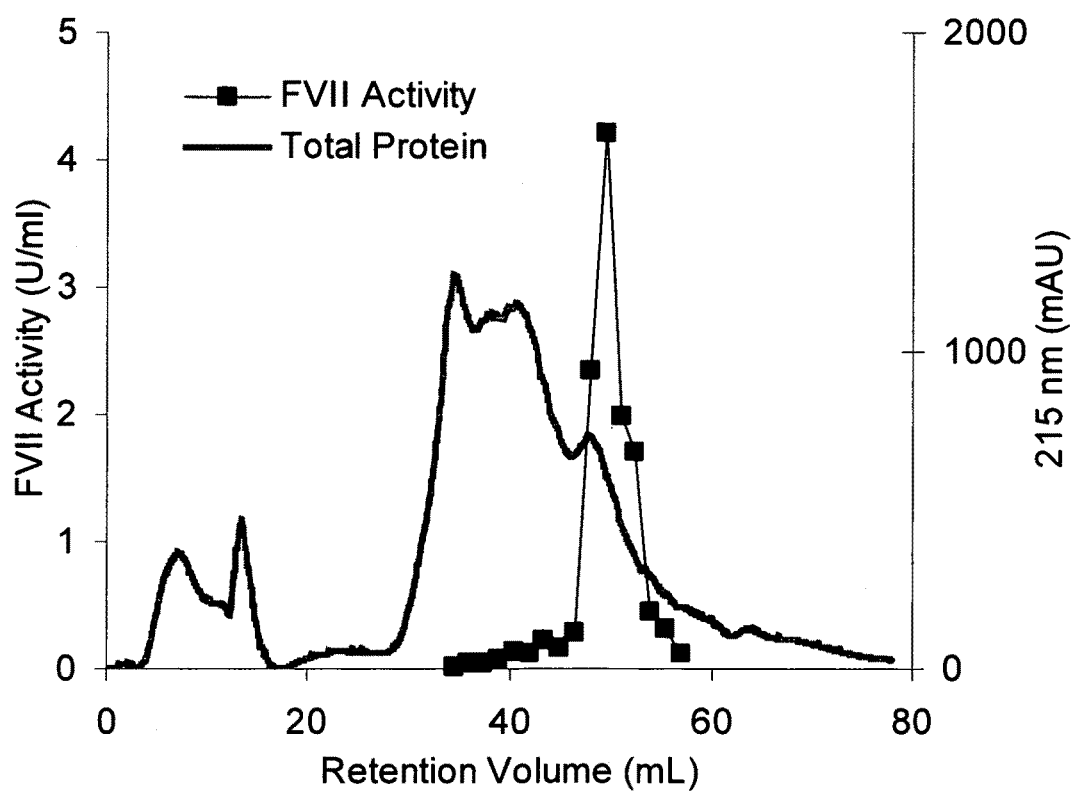
FIG. 19 shows the purification of FVII-AE864 by anion exchange chromatography (see Example 26 for experimental details). The chromatograms depict the elution profiles of the total protein content and the FVII activity from a Macrocap Q column with the bulk of the activity eluting later than the contaminant proteins, creating a net 5-fold purification.

A sample of FVII-AE864 (AC404) containing supernatant was concentrated and buffer exchanged into 10 mM tris pH 7.5, 1 mM EDTA and then adjusted to a final concentration of ~5 mM CaCl2 with the addition of 1M CaCl2. The sample was loaded onto a 2 ml macrocap Q column equilibrated on an Akta chromatography system. The protein was eluted with a linear gradient of 0-100% buffer B over 20 column volumes. Buffer A was comprised of 20 mM MES, 5 mM CaCl2 pH 6.0 and buffer B was comprised of 20 mM MES, 5 mM CaCl2 pH 6.0 and 500 mM NaCl. Fractions were assayed for FVII activity using a PT based factor assay with Innovin as the activating thromboplastin. A single tight peak of activity was seen eluting between 47.9 and 52.4 ml, or 23.2 to 27.8 mS/cm (FIG. 19). A Bradford assay was performed to determine the total amount of protein in the load and elution fractions. The ratio of the activity to the total protein demonstrated an ~5 fold net purification from the column.

Purification of FVII-XTEN_AE864 by Hydrophobic Interaction Chromatography

Figure 20:
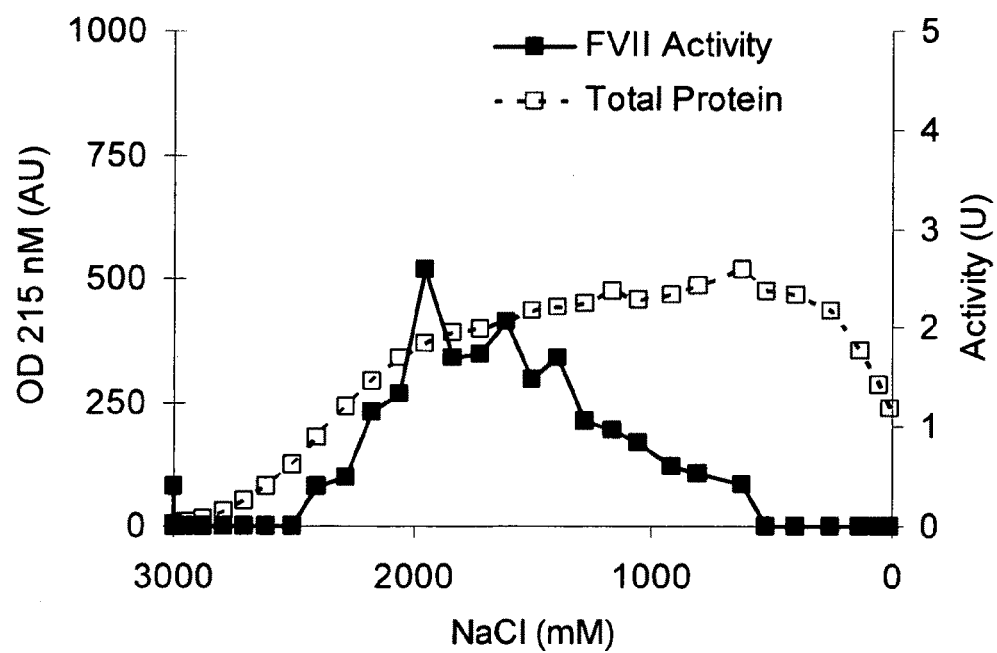
FIG. 20 shows purification of FVII-AE864 by hydrophobic interaction chromatography (see Example 26 for experimental details). The chromatograms depict the elution profiles of the total protein content and the FVII activity from a toyopearl phenyl column with the bulk of the activity eluting earlier than the contaminant proteins, creating a net 2-fold purification

A sample of FVII-AE864 (AC404) containing supernatant was concentrated and buffer exchanged into 10 mM tris pH 7.5, 1 mM EDTA and then adjusted to a final concentration of ~5 mM CaCl2 with the addition of 1M CaCl2. The sample was loaded onto a 2 ml toyopearl phenyl column equilibrated on an Akta chromatography system. The protein was eluted with a linear gradient of 0-100% buffer B over 20 column volumes. Buffer A was comprised of 10 mM Tris, 5 mM CaCl2, 3M NaCl, pH 7.5 and buffer B was comprised of 10 mM Tris, 5 mM CaCl2, pH 7.5. Fractions were assayed for FVII activity using a PT based factor assay with Innovin as the activating thromboplastin. A single peak of activity was seen eluting between 1M and 2M NaCl (FIG. 20). A Bradford assay was performed to determine the total amount of protein in the load and elution fractions. The ratio of the activity to the total protein demonstrated an ~2 fold net purification from the column.

Removal of Aggregated Protein from Monomeric FVII-AE864 with Anion Exchange Chromatography Affinity purified FVII-AE864 (AC404) was loaded was adjusted to pH 6.0 by addition of 200 mM MES, 210 mM CaCl2 pH 6.0 at a ratio of 1 ml buffer to 10 ml sample. Using an Akta FPLC system the sample was purified using a 2 ml macrocap Q column. The column was equilibrated into buffer A (20 mM MES, 1 mM CaCl2, pH 6.0) and the sample loaded. The sample was eluted using a linear gradient of 30% to 80% buffer B (20 mM MES, 1 mM CaCl2, pH 6.0+500 mM NaCl) over 20 column volumes. The 215 nm chromatogram showed two peaks in the elution profile (FIG. 21A). The fractions corresponding to the early peak and the late peak were pooled and analyzed via size exclusion chromatography (SEC) with 60 cm BioSep G4000 column. The early peak contained a monodispersed population with a characteristic hydrodynamic radius of a monomeric AE864 protein (10.1 nm or apparent MW of 1.9 MDa) (FIG. 21B). The late peak contained two populations, the smaller monomeric peak demonstrating the absence of aggregates in the early peak. and an earlier eluting, larger peak at the void volume of the column (22 ml) characteristic of aggregated protein.

SEC Analysis of FVII-AE864 and FVII-AE288

Figure 18:
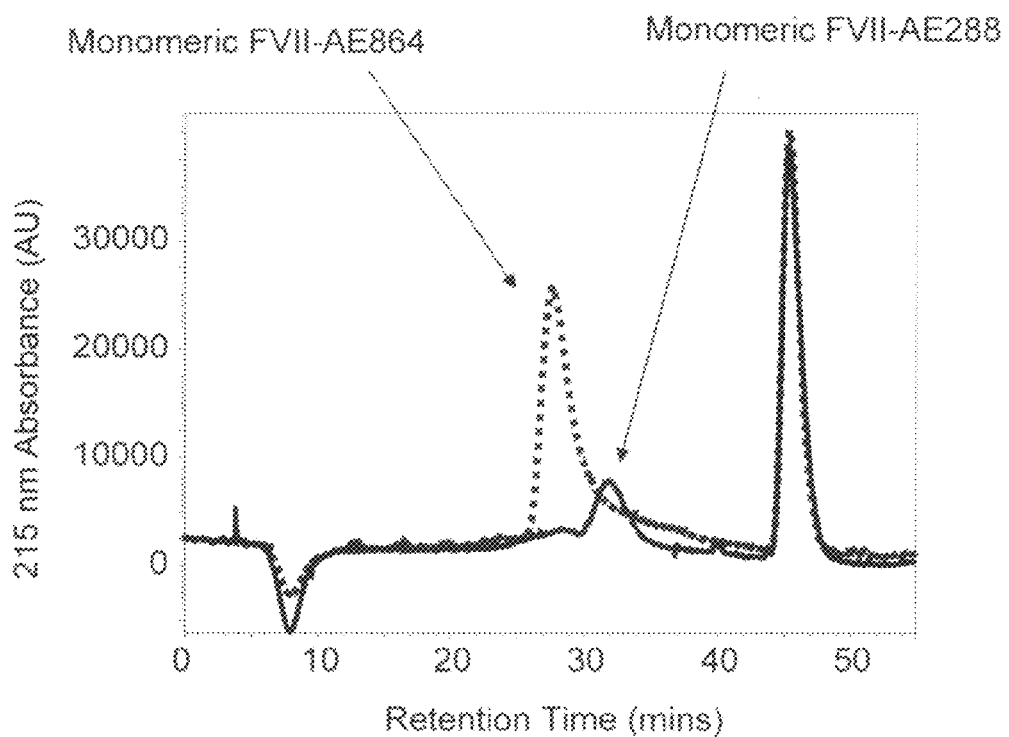
FIG. 18 shows SEC Analysis of FVII-AE864 and FVII-AE288 (see Example 26 for experimental details). The SEC shows a monodispersed population with minimal contamination and no aggregates at the void volume of the column (~22 ml).

FVII-AE864 (AC404) and FVII-AE288 (AC398) were purified by affinity and anion exchange chromatography and characterized. Size exclusion chromatography with 60 cm BioSep G4000 column indicated a monodispersed population with a characteristic hydrodynamic radius for either a monomeric AE864 protein (10.1 nm or apparent MW of 1.9 MDa for an apparent molecular weight factor of 15.2) or a monomeric AE288 protein (8.2 nm or apparent MW of 650 kDa for an apparent molecular weight factor of 9.0) (FIG. 18). Minimal aggregation was seen in either sample. SDS-PAGE showed a >90% pure protein with minimal host cell protein contamination.

Lipidated Tissue Factor Initiated Clotting Activity Analysis of FVII-AE864 and FVII-AE288

Activity was assayed by a PT based factor VII assay as follows: A standard curve was prepared by diluting normal plasma ten fold with FVII deficient plasma and then conducting 4, 5 fold serial dilutions again with factor VII deficient plasma. This created a standard curve with points at 100, 20, 4, 0.8 and 0.16 mUnits/ml of activity, where one unit of activity is defined as the amount of FVII activity in 1 ml of normal human plasma. A FVII-deficient plasma was also included to determine the background level of activity in the null plasma. The sample was prepared by adding FVII-XTEN to FVII deficient plasma at a ratio of 1:10 by volume. The samples were incubated at 37 C in a molecular devices plate reader spectrophotometer for 3 minutes at which point the clotting reaction was initiated by the addition of 2 volumes of thromboplastin (Dade Innovin, B4212-50) per one volume of sample. The turbidity was monitored at 405 nm for 5 minutes to create reaction profiles. The PT time, or time to onset of clotting activity, was defined as the first time where OD405 nm increased by 0.06 over baseline. A log-linear standard curve was created with the log of activity relating linearly to the PT time. From this the activity of the sample in the plate well was determined and then the activity in the sample determined by multiplying by 11 to account for the dilution into the FVII deficient plasma. Based upon quadruplicate measurements the activity of the FVII-AE864 (AC404) fusion was 30 Units/ml and the FVII-AE288 (AC398) was 15 U/ml. Additionally, this lapidated tissue factor activation of clotting is used to assay the activity of FVII-XTEN fusions in clotting assays with more sophisticated readouts like thrombin generation assays, TEG assays, rotem assays and other in vitro/ex vivo which involve the detection of clotting enzyme function by substrate turnover, mechanical clot formation or photo-optical clot detection.

Soluble Tissue Factor Initiated Clotting Activity Analysis of FVII-AE864 and FVII-AE288

After activation of FVII-AE288 (AC398) to FVIIa-AE288 the activity was measured by soluble tissue factor (sTF) induced clotting. This is performed using the Stago STA-Clot FVIIa activity assays kit. Briefly, the samples were incubated with sTF, which binds and enhances FVIIa activity, but does not convert FVII to FVIIa, The time to induce a clot in FVII null plasma was defined as the first time where OD405 nm increased by 0.06 over baseline when monitored in the molecular devices plate reader. This time is compared to a standard curve comprised of known FVIIa amounts added into FVII null plasma, and an activity number calculated. The FVIIa-AE288 sample contained an activity equivalent to 112 U/ml of FVIIa activity. Additionally, this soluble tissue factor activation of clotting is used to assay the activity of FVII-XTEN fusions in clotting assays with more sophisticated readouts like thrombin generation assays, TEG assays, rotem assays and other in vitro/ex vivo which involve the detection of clotting enzyme function by substrate turnover, mechanical clot formation or photo-optical clot detection.

ELISA Based Concentration Determination of FVII-AE864 and FVII-AE288

FVII-XTEN fusion concentrations were determined using and ELISA assay with an affinity purified polyclonal sheep anti-human FVII antibody, where an unmodified form of the antibody is used to capture the protein and the HRP conjugated form was used to detect the protein. The capture antibody was coated at 4 C overnight on to a high binding 96 well assay plate (Corning 3690). The plate was blocked with 3% BSA in PBS for 1 hour at room temperature. The plate was washed 6 times in PBST with a plate washer. Samples or standards, diluted in PBST, were then bound into the appropriate wells for 2 hours at room temperature. The standard curve ranged from 10 ng/ml to <1 pg/ml and was prepared by serially diluting commercial plasma derived FVII of a known concentration (Abcam Cat #ab62386) in PBST. The plate was again washed 6 times with PBST using a plate washer. The FVII-XTEN was then detected using the detection antibody which was bound for 1 hour at 37 C. The plate was again washed 6 times with PBST using a plate washer and washed one further time with water. Signal was then developed with TMB substrate and quantified by reading at 405 nm on a molecular devices plate reader spectrophotometer. A four parameter fit is then performed on the standards and the concentration of the samples determined by comparison to the standard curve.

Assessment of FVII-AE864 and FVII-AE288 Activity Via Direct Turnover of a Fluorogenic Substrate FVII-XTEN fusion activity is determined by monitoring the cleavage of a peptide bond in the substrate D-FPR-6-amino-1-naphthalenesulfonamide (D-FPR-ANSN) where the DFPR moiety is a peptide chain linked to a secondary amine in the ANSH moiety. When the bond between the arginine residue and the ANSH moiety is cleaved by the serine protease activity of the FVII catalytic domain the ANSH is released and becomes an intense fluorophore. FVII-XTEN activity is measured at enzyme concentrations ranging from 50 pM to 1 µM with substrate concentrations ranging from 50 µM to 100 µM in 20 mM tris pH 8.0, 135 mM NaCl. By monitoring the change in ANSN fluorescence (excitation 352 nm, emission 470 nm) over time the activity of the FVIIa catalytic domain can be determined. This activity can be compared to a standard curve derived from FVIIa to determine the amount of FVIIa equivalents in the sample, or kinetic properties such as kcat and Km for can be determined.

Assessment of FVII-AE864 and FVII-AE288 Activity Via a FXa Coupled Chromogenic Substrate Assay When complexed to Tissue Factor (TF), in presence of phospholipids and Calcium, FVII and FVII-XTEN activate factor X to factor Xa. Biophen Factor VII is a chromogenic assay for testing factor VII activity. Factor VII forms an enzymatic complex with Tissue Factor, provided by rabbit Thromboplastin. It then activates factor X, present in the assay at a constant concentration and in excess, to factor Xa. The concentration of FXa is exactly measured by its activity on a specific factor Xa chromogenic substrate (SXa-11). Factor Xa cleaves the substrate and generates pNA. The amount of pNA generated is directly proportional to the factor Xa activity. Finally, there is a direct relationship between the amount of factor VII activity in the assayed sample and the factor Xa activity generated, measured by the amount of pNA released, determined by color development at 405 nm. By comparing the signal from an unknown sample to the signal from a standard curve of know FVII activity, it is possible to calculate the amount of FVII activity in an unknown sample.

Example 27

ELISA Assays for FIX-XTEN Concentration Determination

FIX-XTEN concentrations were determined using and ELISA assay with a specific matched pair of antibodies, where the detection antibody was conjugated to HRP to simplify detection (Affinity Biologicals cat #FIX-EIA). The capture antibody was coated at 4 C overnight on to a high binding 96 well assay plate (Corning 3690). The plate was blocked with 3% BSA in PBS for 1 hour at room temperature. The plate was washed 6 times in PBST with a plate washer. Samples or standards, diluted in PBST, were then bound into the appropriate wells for 2 hours at room temperature. The standard curve ranged from 25 ng/ml to <1 pg/ml and was prepared by serially diluting commercial plasma derived FIX of a known concentration (Abcam Cat #ab62544) in PBST. The plate was again washed 6 times with PBST using a plate washer. The FIX was then detected using the detection antibody which was bound for 1 hour at 37 C. The plate was again washed 6 times with PBST using a plate washer and washed one further time with water. Signal was then developed with TMB substrate and quantified by reading at 405 nm on a molecular devices plate reader spectrophotometer. A four parameter fit is then performed on the standards and the concentration of the samples determined by comparison to the standard curve.

Example 28 aPTT Based Assays for FIX-XTEN Activity Determination

FIX-XTEN would act to replace FIX in the intrinsic or contact activated coagulation pathway. The activity of this coagulation pathway is assessed using an activated partial thromboplastin time assay (aPTT). FIX activity specifically was measured as follows, a standard curve was prepared by diluting normal control plasma (Pacific Hemostasis cat #100595) two fold with FIX deficient plasma (cat #100900) and then conducting 6, 4 fold serial dilutions again with factor IX deficient plasma. This created a standard curve with points at 500, 130, 31, 7.8, 2.0, 0.5 and 0.1 mUnits/ml of activity, where one unit of activity is defined as the amount of FIX activity in 1 ml of normal human plasma. A FIX-deficient plasma was also included to determine the background level of activity in the null plasma. The sample was prepared by adding FIX-XTEN to FIX deficient plasma at a ratio of 1:10 by volume. The samples were tested using an aPTT assay as follows. The samples were incubated at 37 C in a molecular devices plate reader spectrophotometer for 2 minutes at which point an equal volume of aPTT reagent (Pacific Hemostasis cat #100402) was added and an additional 3 minute 37 C incubation performed. After the incubation the assay was activated by adding one volume of calcium chloride (Pacific Hemostasis cat #100304). The turbidity was monitored at 450 nm for 5 minutes to create reaction profiles. The aPTT time, or time to onset of clotting activity, was defined as the first time where OD405 nm increased by 0.06 over baseline. A log-linear standard curve was created with the log of activity relating linearly to the aPTT time. From this the activity of the sample in the plate well was determined and then the activity in the sample determined by multiplying by 11 to account for the dilution into the FIX deficient plasma.

Example 29

FIX/cFXI/XTEN has Enhanced Activity Compared to FIX-XTEN

Figure 22:
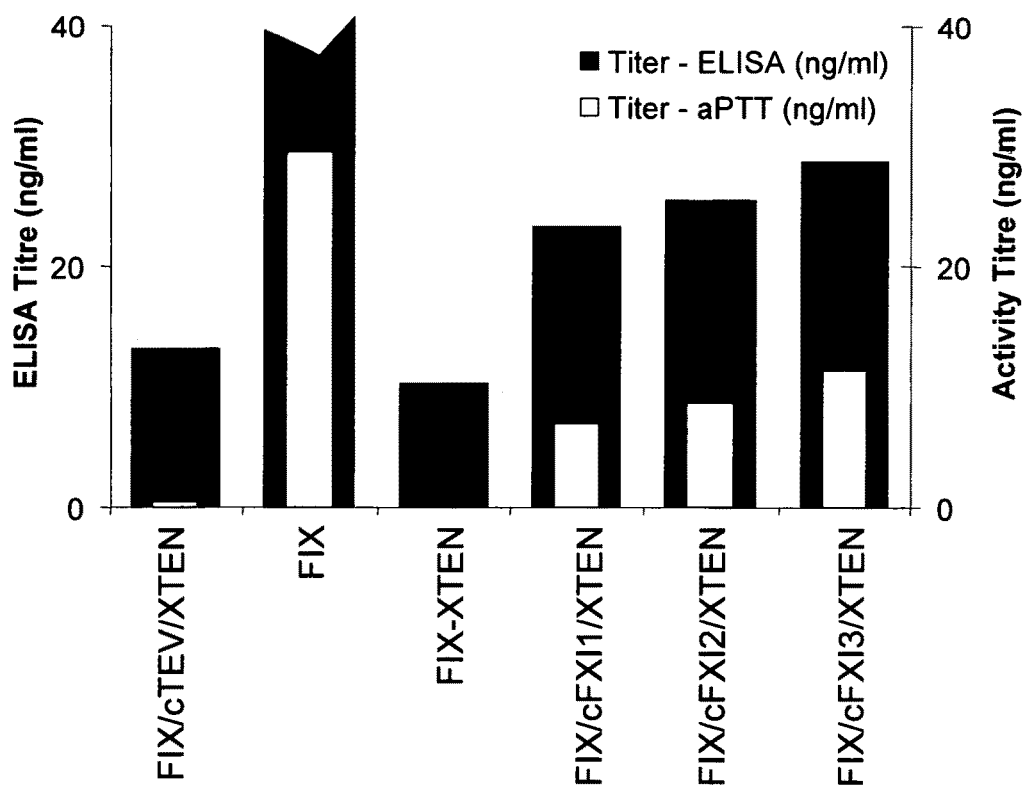
FIG. 22 shows results of ELISA or aPTT assays, showing FIX/cFXI/XTEN has enhanced activity compared to FIX-XTEN (see Example 29 for experimental details). Transiently expressed FIX constructs were assayed for antigen content by ELISA and for activity by aPTT based assays. While the antigen content of FIX-XTEN was similar to the FIX/cFXI/XTEN constructs the activity was significantly increased. This increase is attributed to the specific action of the FXI protease in the assays as the FIX/cTEV/XTEN does not show a significantly different activity to FIX-XTEN. Note the ELISA titer of the FIX sample is 197 ng/ml and is off the scale of the graph.

FIX (pCW0596), FIX-XTEN (pCW0597), FIX/cFXI1/XTEN (pCW0735), FIX/cFXI2/XTEN (pCW0736) and FIX/cFXI3/XTEN (pCW0737) were transiently expressed in CHO-K1 cells. Transient transfection supernatants were concentrated in 30,000 MWCO concentrators by approximately 15-fold. The concentration of the concentrated and unconcentrated samples was determined by ELISA. The clotting activity of the concentrated samples was then determined using an aPTT based factor assay. For the XTEN containing the activity was drastically altered by the presence any of the FXIc cleavage sites. In all three cases the presence of a FXI cleavage site enhanced the clotting activity by greater than 30-fold (see FIG. 22 and Table 28). The relatively consistent ELISA measurement indicates that this is an enhancement of the specific activity, rather than a change in titer. Additionally, the ratio of the activity measurement to the ELISA concentration for the FXI cleavage site constructs was now similar to the ratios for FIX, indicating that the FIX-FXIc-XTEN contained a FIX domain of similar properties to the FIX domain expressed in the absence of XTEN.

TABLE 28

Activity of FIX/cFXI/XTEN Constructs

| Construct | Concentration by ELISA (ng/ml) | Concentration by Activity (ng/ml) | Fraction Active |
|---|---|---|---|
| FIX/cTEV/XTEN | NA | NA | 4% |
| FIX | 197 | 30 | 15% |
| FIX-XTEN | 10 | 0 | 2% |
| FIX/cFXI1/XTEN | 23 | 7 | 30% |
| FIX/cFXI2/XTEN | 26 | 9 | 34% |
| FIX/cFXI3/XTEN | 29 | 11 | 40% |

Example 30

Pharmacokinetic Analysis of CFXTEN Fusion polypeptide in Rats-FVII-XTEN_AE864

The pharmacokinetics of the CFXTEN FVII-XTEN_AE864, compared to FVII alone, were tested in Sprague-Dawley. FVII-XTEN_AE864 and FVII were administered to female Sprague-Dawley rats (n=3) IV through a jugular vein catheter at 3 µg/rat. Blood samples (0.2 mL) were collected into prechilled heparinized tubes at predose, 0.08, 0.5, 1, 2, 4, 8, 24, 48, 72 hour time points, and processed into plasma. Quantitation of the test articles was performed by ELISA assay using an anti-FVII antibody for both capture and detection. A non-compartmental analysis was performed in WinNonLin with all time points included in the fit to determine the PK parameters.

Figure 23:
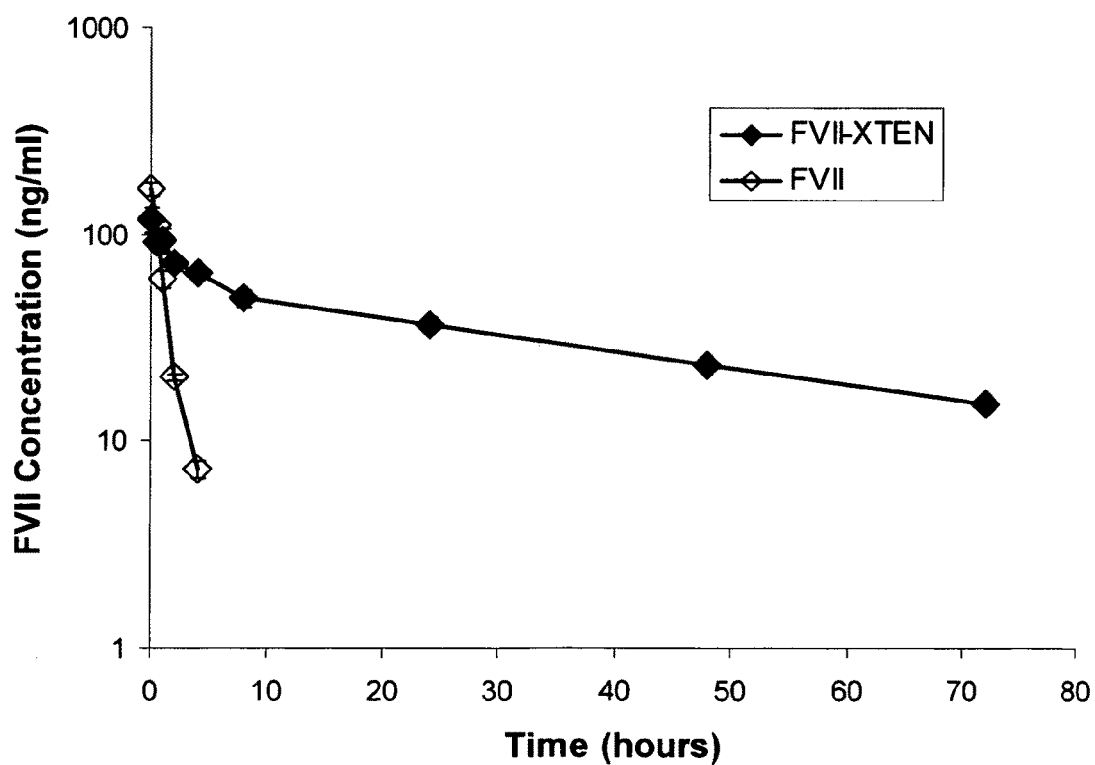
FIG. 23 shows the pharmacokinetic profile after a single dose administered subcutaneously to rats, with the derived equivalent FVII concentration shown, as described in Example 30.

The pharmacokinetic results are summarized in Table 29 and FIG. 23. The data show XTEN can greatly extend the half-life of FVII as a CFXTEN fusion protein as compared to FVII alone; FVII-XTEN has a half life of approximately 38 hours as compared to 1 hour for FVII. In addition FVII-XTEN was confined to the bloodstream, with a calculated volume of distribution of 50.8 mL in rats, indicating little extravasation into the extracellular space.

TABLE 29

Half-life of FVII test articles in rats

| Test Article (Construct) | T ½ (hrs) |
|---|---|
| FVII-XTEN(AP315) | 37.9 |
| FVII (P318) | 1.0 |

Example 31

Pharmacokinetic Analysis of CF XTEN Fusion polypeptide in Rats-FIX-XTEN_AE864

The pharmacokinetics of macrocap Q purified FIX-XTEN_AE864 were tested in Sprague-Dawley rats (n=3) and compared to unpurified FIX-XTEN, FIX-XTEN TEV cleaved (a preparation in which the XTEN is removed from the fusion protein by use of TEV protease), and commercially-available FIX Benefix. Compounds were administered to female Sprague-Dawley rats IV through jugular vein catheter at 3 µg/rat. Blood samples (0.2 mL) were collected into prechilled heparinized tubes at predose, 0.08, 0.5, 1, 2, 4, 8, 24, 48, 72 hour time points, and processed into plasma. Quantitation of the test articles was performed by ELISA assay using an anti-FIX antibody for both capture and detection. A non-compartmental analysis was performed in WinNonLin with all time points included in the fit to determine the PK parameters.

Figure 24:
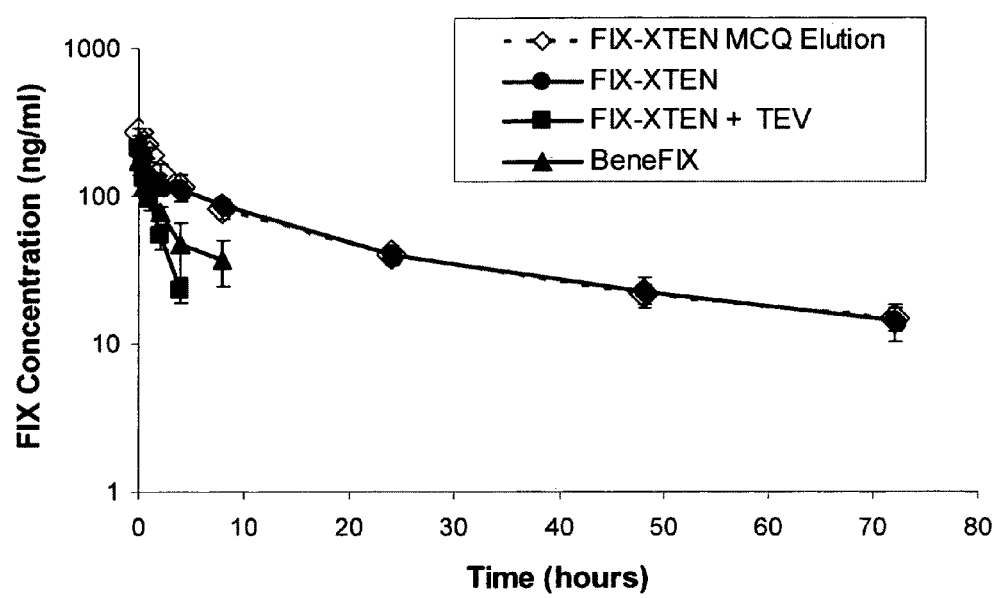
FIG. 24 shows the pharmacokinetic profile after a single dose administered subcutaneously to rats, with the derived equivalent FIX concentration shown, as described in Example 31.

The pharmacokinetic results are summarized in Table 30 and FIG. 24. The data show XTEN can greatly extend the half life of FIX as a CFXTEN fusion protein as compared to either FIX-XTEN TEV cleaved or FIX Benefix; FIX-XTEN has a half life of 34.7 hours as compared to 4.6 hour for FIX Benefix. In addition FIX-XTEN was confined to the bloodstream with a calculated volume of distribution of 38 mL in rats, indicating little extravasation into the extracellular space.

TABLE 30

Half-life of FIX test articles in rats

| Test Article (Construct) | T ½ (hrs) |
|---|---|
| FIX-XTEN macro cap Q (AP316a) | 34.7 |
| FIX-XTEN (AP316) | 33.1 |
| FIX-XTEN TEV (AP316b) | 1.5 |
| FIX Benefix | 3.3 |

Example 32

Pharmacodynamic Evaluation of FVIIa-XTEN_AE864 in Animal Models

The in vivo pharmacologic activity of FVIIa-XTEN constructs is assessed using a variety of preclinical models of bleeding including but not limited to those of hemophilia, surgery, trauma, thrombocytopenia/platelet dysfunction, clopidogrel/heparin-induced bleeding and hydrodynamic injection. These models can be developed in multiple species including mice, rat, rabbits, and dogs using methods equivalent to those used and published for other FVIIa approaches. FVIIa-XTEN compositions are provided in an aqueous buffer compatible with in vivo administration (for example: phosphate-buffered saline or Tris-buffered saline). The compositions are administered at appropriate doses, dosing frequency, dosing schedule and route of administration as optimized for the particular model. Efficacy determinations include measurement of FVIIa activity, prothrombin time (PT), activated partial prothrombin time (aPTT), bleeding time, whole blood clotting time (WBCT), thrombelastography (TEG or ROTEM), among others.

In one example of a PD model, FVIIa-XTEN and FVII are administered to genetically-deficient or experimentally-induced HemA or HemB mice. At various time points post-administration, levels of FVIIa and FVIIa-XTEN are measured by ELISA, activity of FVIIa and FVIIa-XTEN are measured by commercially-available FVIIa activity kits and clotting time is measured by PT assay. Overall, the results can indicate that the FVIIa-XTEN constructs may be more efficacious at inhibiting bleeding as compared to FVIIa and/or equivalent in potency to comparable dosage of FVIIa with less frequent or more convenient dosing intervals.

In a mouse bleeding challenge PD model FVIIa-XTEN and FVIIa are administered to genetically-deficient or experimentally-induced HemA or HemB mice and effect on hemostatic challenge is measured. Hemostatic challenge can include tail transaction challenge, hemarthropthy challenge, joint bleeding or saphenous vein challenge among others. At various time points post-administration levels of FVII and FVIIa-XTEN are measured by ELISA, activity of FVII and FVIIa-XTEN are measured by commercially available FVIIa activity kit, bleeding time is measured and clotting time is measured by PT assay. Overall the results can indicate that the VIIa-XTEN constructs may be more efficacious at inhibiting bleeding as compared to FVIIa and/or equivalent in potency to comparable dosage of FVIIa with less frequent or more convenient dosing intervals.

In a dog PD model, FVIIa-XTEN and FVII are administered to genetically-deficient hemophiliac dogs. At various time points post administration, levels of FVIIa and FVIIa-XTEN are measured by ELISA, activity of FVIIa and FVIIa-XTEN are measured by commercially available FVIIa activity kit and clotting time is measured by PT assay. Overall the results can indicate that the FVIIa-XTEN constructs may be more efficacious at inhibiting bleeding as compared to FVIIa and/or equivalent in potency to comparable dosage of FVIIa with less frequent or more convenient dosing.

In a dog bleeding challenge PD model FVIIa-XTEN and FVIIa are administered to genetically deficient hemophiliac dogs and effect on hemostatic challenge is measured. Hemostatic challenge can include cuticle bleeding time among others. At various time points post administration levels of FVII and FVIIa-XTEN are measured by ELISA, activity of FVII and FVIIa-XTEN are measured by commercially available FVIIa activity kit, bleeding time is measured and clotting time is measured by PT assay. Overall the results can indicate that the VIIa-XTEN constructs may be more efficacious at inhibiting bleeding as compared to FVIIa and/or equivalent in potency to comparable dosage of FVIIa with less frequent or more convenient dosing intervals.

Additional preclinical models of bleeding include but are not limited to those of hemophilia, surgery, trauma, thrombocytopenia/platelet dysfunction, clopidogrel/heparin-induced bleeding and hydrodynamic injection. These models can developed in multiple species including mice, rat, rabbits, and dogs using methods equivalent to those used and published for other FVIIa approaches. Overall the results can indicate that the FVIIa-XTEN constructs may be more efficacious at inhibiting bleeding as compared to FVIIa and/or equivalent in potency to comparable dosage of FVIIa with less frequent or more convenient dosing intervals.

Example 33

Pharmacodynamic Evaluation of FIX-XTEN_AE864 in Animal Models

The in vivo pharmacologic activity of FIX-XTEN constructs is assessed using a variety of preclinical models of bleeding including, but not limited to, those of hemophilia, surgery, trauma, thrombocytopenia/platelet dysfunction, clopidogrel/heparin-induced bleeding and hydrodynamic injection. These models can be developed in multiple species including mice, rat, rabbits, and dogs using methods equivalent to those used and published for other FIX approaches. FIX-XTEN compositions are provided in an aqueous buffer compatible with in vivo administration (for example: phosphate-buffered saline or Tris-buffered saline). The compositions are administered at appropriate doses, dosing frequency, dosing schedule and route of administration as optimized for the particular model. Efficacy readouts include measurement of FIX activity, PT, aPTT, bleeding time, whole blood clotting time (WBCT), thrombelastography (TEG or ROTEM), among others.

In one example of a PD model, FIX-XTEN and FIX are administered to genetically-deficient or experimentally-induced HemA or HemB mice. At various time points post-administration, levels of FIX and FIX-XTEN are measured by ELISA, activity of FIX and FIX-XTEN are measured by commercially available FIX activity kit and clotting time is measured by aPTT assay. Overall the results can indicate that the FIX-XTEN constructs may be more efficacious at inhibiting bleeding as compared to FIX and/or equivalent in potency to comparable dosage of FIX with less frequent or more convenient dosing intervals.

In a mouse bleeding challenge PD model FIX-XTEN and FIX are administered to genetically deficient or experimentally induced HemA or Hem B mice and effect on hemostatic challenge is measured. Hemostatic challenge can include tail transaction challenge, hemarthropthy challenge, joint bleeding or saphenous vein challenge among others. At various time points post administration levels of FIX and FIX-XTEN are measured by ELISA, activity of FIX and FIX-XTEN are measured by commercially available FIX activity kit, bleeding time is measured and clotting time is measured by aPTT assay. Overall the results can indicate that the FIX-XTEN constructs may be more efficacious at inhibiting bleeding as compared to FIX and/or equivalent in potency to comparable dosage of FIX with less frequent or more convenient dosing intervals.

In a dog PD model, FIX-XTEN and FIX are administered to genetically-deficient hemophiliac dogs. At various time points post-administration, levels of FIX and FIX-XTEN are measured by ELISA, activity of FIX and FIX-XTEN are measured by commercially available FIX activity kit and clotting time is measured by aPTT assay. Overall, the results can indicate that the FIX-XTEN constructs may be more efficacious at inhibiting bleeding as compared to FIX and/or equivalent in potency to comparable dosage of FIX with less frequent or more convenient dosing intervals.

In a dog bleeding challenge PD model FIX a-XTEN and FIX are administered to genetically-deficient hemophiliac dogs and effect on hemostatic challenge is measured. Hemostatic challenge can include cuticle bleeding time, amongst other assays. At various time points post-administration levels of FIX and FIX-XTEN are measured by ELISA, activity of FIX and FIX-XTEN are measured by commercially available FIX activity kit, bleeding time is measured and clotting time is measured by aPTT assay. Overall, the results can indicate that the FIX-XTEN constructs may be more efficacious at inhibiting bleeding as compared to FIX and/or equivalent in potency to comparable dosage of FIX with less frequent or more convenient dosing intervals.

Additional preclinical models of bleeding include, but are not limited to, those of hemophilia, surgery, trauma, thrombocytopenia/platelet dysfunction, clopidogrel/heparin-induced bleeding and hydrodynamic injection. These models can be developed in multiple species, including mice, rat, rabbits, and dogs using methods equivalent to those used and published for other FIX approaches. Overall the results can indicate that the FIX-XTEN constructs may be more efficacious at inhibiting bleeding as compared to FIX and/or equivalent in potency to comparable dosage of FIX with less frequent or more convenient dosing intervals.

Example 34

CFXTEN with Cleavage Sequences

C-Terminal XTEN Releasable by FXIa

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site cleavage sequence can be incorporated into the FIX-XTEN that contains an amino acid sequence that is recognized and cleaved by the FXIa protease (EC 3.4.21.27, Uniprot P03951). Specifically the amino acid sequence KLTRAET (SEQ ID NO: 6) is cut after the arginine of the sequence by FXIa protease. FXI is the pro-coagulant protease located immediately before FIX in the intrinsic or contact activated coagulation pathway. Active FXIa is produced from FXI by proteolytic cleavage of the zymogen by FXIIa. Once activated, its natural role in coagulation is to activate FIX by excising a peptide from zymogen by cutting the protein at positions R191 and R226 of FIX, which then perpetuates the coagulation pathway. Production of FXIa is tightly controlled and only occurs when coagulation is necessary for proper hemostasis. Therefore, by incorporation of the KLTRAET cleavage sequence (SEQ ID NO: 6), the XTEN domain would only be removed from FIX concurrent with activation of the intrinsic coagulation pathway and when coagulation is required physiologically. This creates a situation where the FIX-XTEN fusion protein is processed in one additional manner during the activation of the intrinsic pathway. In addition to the natural cleavages that occur at R191 and R226 of the FIX domain by FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by FXIIa

Figure 3:
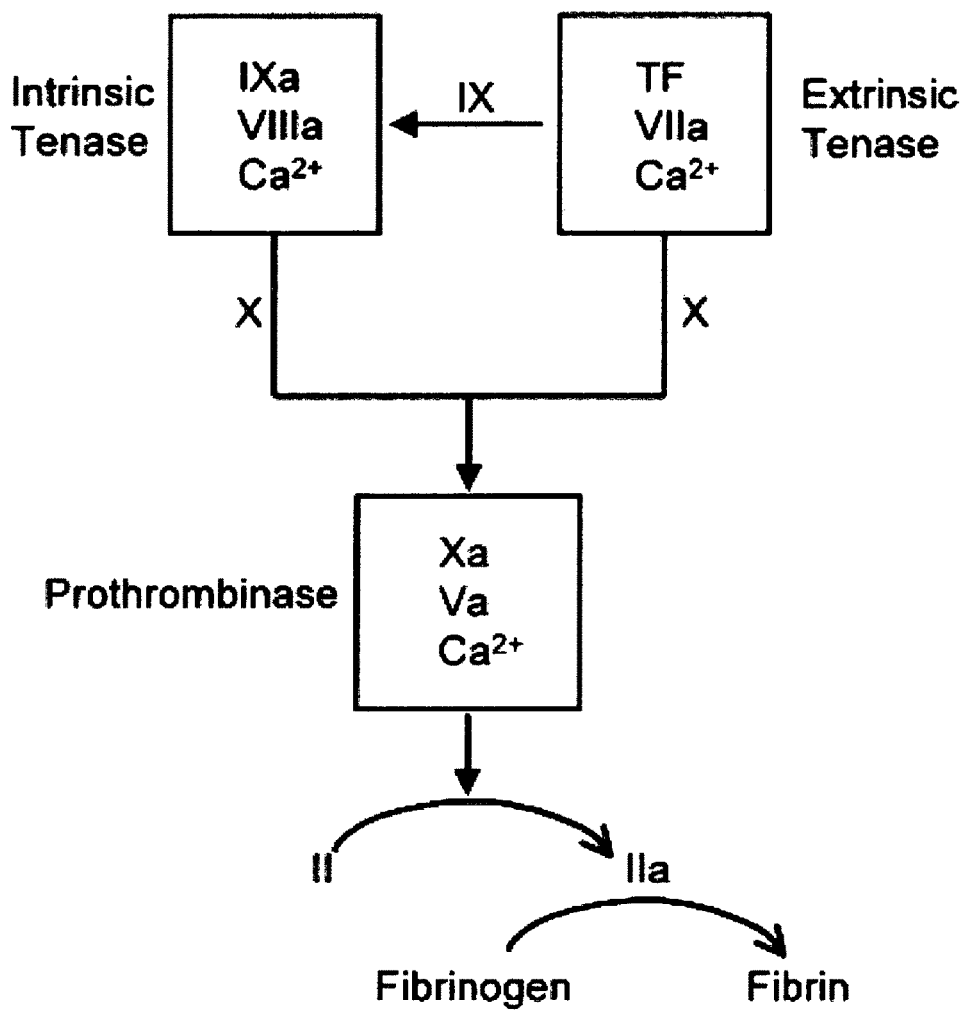
FIG. 3 is a schematic of the coagulation cascade, showing both the extrinsic and intrinsic pathways.

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the XTEN release site sequence can contain an amino acid sequence that is recognized and cleaved by the FXIIa protease (EC 3.4.21.38, Uniprot P00748). Specifically the sequence TMTRIVGG (SEQ ID NO: 89) is cut after the arginine at position 4 of the sequence. FXII is a pro-coagulant protease located before FIX in the intrinsic or contact activated coagulation pathway. Active FXIIa is produced from FXII by contact with non-self surfaces and by cleavage by kallikrein. Once activated its natural role in coagulation is to activate FXI (FIG. 3) by proteolytic cleavage of the zymogen, which then in turn, perpetuates the coagulation pathway. Production of FXIIa is tightly controlled and only occurs when coagulation is necessary for proper hemostasis. Therefore, by incorporation of the TMTRIVGG cleavage sequence (SEQ ID NO: 89), the XTEN domain would only be removed from FIX concurrent with activation of the intrinsic coagulation pathway and when coagulation is required physiologically. This creates a situation where FIX-XTEN fusion is processed in one additional manner during the activation of the intrinsic pathway. In addition to the natural cleavages that occur at R191 and R226 of the FIX domain by FXIa, a third cleavage would occur at the XTEN release site that would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by Kallikrein

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the XTEN release site sequence can an amino acid sequence that is recognized and cleaved by the kallikrein protease (EC 3.4.21.34, Uniprot P03952). Specifically the sequence SPFRVVGG (SEQ ID NO: 620) [Rawlings N. D., et al. (2008) Nucleic Acids Res., 36: D320], is cut after the arginine at position 4 of the sequence. Kallikrein is a pro-coagulant protease located before FIX in the intrinsic or contact activated coagulation pathway. Active Kallikrein is produced from Plasma Kallirien by contact with non-self surfaces. Once activated its natural role in coagulation is to activate FXII (FIG. 3) by proteolytic cleavage of the zymogen, which then in turn, perpetuates the coagulation pathway. Production of kallikrien is tightly controlled and only occurs when coagulation is necessary for proper hemostasis. Therefore, by incorporation of the SPFRVVGG cleavage sequence (SEQ ID NO: 620) the XTEN domain would only be removed from FIX concurrent with activation of the intrinsic coagulation pathway and when coagulation is required physiologically. This creates a situation where FIX-XTEN fusion is processed in one additional manner during the activation of the intrinsic pathway. In addition to the natural cleavages that occur at R191 and R226 of the FIX domain by FXIa, a third cleavage would occur at the XTEN release site that would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by FVIIa

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site sequence contains an amino acid sequence that is recognized and cleaved by the FVIIa protease (EC 3.4.21.21, Uniprot P08709). Specifically the sequence LQVRIVGG (SEQ ID NO: 91) [Rawlings N. D., et al. (2008) Nucleic Acids Res., 36: D320], is cut after the arginine at position 4 in the sequence. FVIIa is a pro-coagulant protease located before FIX in the extrinsic or cellular injury activated coagulation pathway. Active FVIIa is produced from FVII in an autocatalytic process aided by binding to tissue factor, phospholipids and calcium. Once activated its natural role in coagulation is to activate FIX and FX (FIG. 3) by proteolytic cleavage of the zymogens, which then in turn, perpetuate the coagulation pathway. FVIIa activity is tightly controlled and only occurs when coagulation is necessary for proper hemostasis. Therefore, by incorporation of the LQVRIVGG cleavage sequence (SEQ ID NO: 91) the XTEN domain would only be removed from FIX concurrent with activation of the intrinsic coagulation pathway and when coagulation is required physiologically. This creates a situation where FIX-XTEN fusion is processed in one additional manner during the activation of the intrinsic pathway. In addition to the natural cleavages that would occur at R191 and R226 of the FIX domain by FVIIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by FIXa

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site cleavage sequence contains an amino acid sequence that is recognized and cleaved by the FIXa protease (EC 3.4.21.22, Uniprot P00740). Specifically the sequence PLGRIVGG (SEQ ID NO: 92) [Rawlings N. D., et al. (2008) Nucleic Acids Res., 36: D320], is cut after the arginine at position 4 of the sequence. Active FIXa is produced by cleavage of FIX by either FXIa or FVIIa in the presence of phospholipids and calcium. Once activated its natural role in coagulation is to activate FX (FIG. 3) by proteolytic cleavage of the zymogen, which then in turn, perpetuates the coagulation pathway. FIXa activity is tightly controlled and only occurs when coagulation is necessary for proper hemostasis. Therefore, by incorporation of the PLGRIVGG sequence (SEQ ID NO: 92), the XTEN domain would only be removed from FIX concurrent with activation of either the extrinsic or intrinsic coagulation pathways, and when coagulation is required physiologically. This creates a situation where FIX-XTEN fusion is processed in one additional manner during the activation of the intrinsic pathway. In addition to the natural cleavages that would occur at R191 and R226 of the FIX domain by FVIIa or FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by FXa

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the FXa protease (EC 3.4.21.6, Uniprot P00742). Specifically the sequence IEGRTVGG (SEQ ID NO: 93) [Rawlings N. D., et al. (2008) Nucleic Acids Res., 36: D320], is cut after the arginine at position 4 in the sequence. Active FXa is produced by cleavage of FX by FIXa in the presence of phospholipids and calcium and is the step immediately down stream from factor IX in the coagulation pathway. Once activated its natural role in coagulation is to activate FII (FIG. 3) by proteolytic cleavage of the zymogen, which then in turn, perpetuates the coagulation pathway. FXa activity is tightly controlled and only occurs when coagulation is necessary for proper hemostasis. Therefore, by incorporation of the IEGRTVGG sequence (SEQ ID NO: 93), the XTEN domain would only be removed from FIX concurrent with activation of either the extrinsic or intrinsic coagulation pathways, and when coagulation is required physiologically. This creates a situation where FIX-XTEN fusion is processed in one additional manner during the activation of clotting. In addition to the natural cleavages that would occur at R191 and R226 of the FIX domain by FVIIa or FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by FIIa (Thrombin)

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the FIIa protease (EC 3.4.21.5, Uniprot P00734). Specifically the sequence LTPRSLLV (SEQ ID NO: 94) [Rawlings N. D., et al. (2008) Nucleic Acids Res., 36: D320], is cut after the arginine at position 4 in the sequence. Active FIIa is produced by cleavage of FII by FXa in the presence of phospholipids and calcium and is down stream from factor IX in the coagulation pathway. Once activated its natural role in coagulation is to cleave fibrinogin (FIG. 3), which then in turn, begins clot formation. FIIa activity is tightly controlled and only occurs when coagulation is necessary for proper hemostasis. Therefore, by incorporation of the LTPRSLLV sequence (SEQ ID NO: 94), the XTEN domain would only be removed from FIX concurrent with activation of either the extrinsic or intrinsic coagulation pathways, and when coagulation is required physiologically. This creates a situation where FIX-XTEN fusion is processed in one additional manner during the activation of coagulation. In addition to the natural cleavages that would occur at R191 and R226 of the FIX domain by FVIIa or FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule is processed to produce free FIXa which reconstitutes or augments clotting function in a subject in need thereof.

C-Terminal XTEN Releasable by Elastase-2

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the elastase-2 protease (EC 3.4.21.37, Uniprot P08246). Specifically the sequence LGPVSGVP (SEQ ID NO: 95) [Rawlings N. D., et al. (2008) Nucleic Acids Res., 36: D320], is cut after position 4 in the sequence. Elastase is constitutively expressed by neutrophils and is present at all times in the circulation. Its activity is tightly controlled by serpins and is therefore minimally active most of the time. Therefore as the long lived FIX-XTEN circulates, a fraction of it is cleaved, creating a pool of shorter-lived FIX to be used in coagulation. In a desirable feature of the inventive composition, this creates a circulating pro-drug depot that constantly releases a prophylactic amount of FIX.

C-Terminal XTEN Releasable by MMP-12

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the MMP-12 protease (EC 3.4.24.65, Uniprot P39900). Specifically the sequence GPAGLGGA (SEQ ID NO: 97) [Rawlings N. D., et al. (2008) Nucleic Acids Res., 36: D320], is cut after position 4 of the sequence. MMP-12 is constitutively expressed in whole blood. Therefore as the long lived FIX-XTEN circulates, a fraction of it is cleaved, creating a pool of shorter-lived FIX to be used in coagulation. In a desirable feature of the inventive composition, this creates a circulating pro-drug depot that constantly releases a prophylactic amount of FIX.

C-Terminal XTEN Releasable by MMP-13

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the MMP-13 protease (EC 3.4.24.-, Uniprot P45452). Specifically the sequence GPAGLRGA (SEQ ID NO: 99) [Rawlings N. D., et al. (2008) Nucleic Acids Res., 36: D320], is cut after position 4. MMP-13 is constitutively expressed in whole blood. Therefore as the long lived FIX-XTEN circulates, a fraction of it is cleaved, creating a pool of shorter-lived FIX to be used in coagulation. In a desirable feature of the inventive composition, this creates a circulating pro-drug depot that constantly releases a prophylactic amount of FIX.

C-Terminal XTEN Releasable by MMP-17

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the MMP-20 protease (EC.3.4.24.-, Uniprot Q9ULZ9). Specifically the sequence APLGLRLR (SEQ ID NO: 101) [Rawlings N. D., et al. (2008) Nucleic Acids Res., 36: D320], is cut after position 4 in the sequence. MMP-17 is constitutively expressed in whole blood. Therefore as the long lived FIX-XTEN circulates, a fraction of it is cleaved, creating a pool of shorter-lived FIX to be used in coagulation. In a desirable feature of the inventive composition, this creates a circulating pro-drug depot that constantly releases a prophylactic amount of FIX.

C-Terminal XTEN Releasable by MMP-20

An FIX-XTEN fusion protein consisting of an XTEN protein fused to the C-terminus of FIX can be created with a XTEN release site cleavage sequence placed in between the FIX and XTEN components, as depicted in FIG. 2F. Exemplary sequences are provided in Table 42. In this case, the release site contains an amino acid sequence that is recognized and cleaved by the MMP-20 protease (EC.3.4.24.-, Uniprot O60882). Specifically the sequence PALPLVAQ (SEQ ID NO: 102) [Rawlings N. D., et al. (2008) Nucleic Acids Res., 36: D320], is cut after position 4 (depicted by the arrow). MMP-20 is constitutively expressed in whole blood. Therefore as the long lived FIX-XTEN circulates, a fraction of it is cleaved, creating a pool of shorter-lived FIX to be used in coagulation. In a desirable feature of the inventive composition, this creates a circulating pro-drug depot that constantly releases a prophylactic amount of FIX.

Optimization of the Release Rate of C-Terminal XTEN

Variants of the foregoing Examples can be created in which the release rate of C-terminal XTEN is altered. As the rate of XTEN release by an XTEN release protease is dependent on the sequence of the XTEN release site, by varying the amino acid sequence in the XTEN release site one can control the rate of XTEN release. The sequence specificity of many proteases is well known in the art, and is documented in several data bases. In this case, the amino acid specificity of proteases is mapped using combinatorial libraries of substrates [Harris, J. L., et al. (2000) Proc Natl Acad Sci USA, 97: 7754] or by following the cleavage of substrate mixtures as illustrated in [Schellenberger, V., et al. (1993) Biochemistry, 32: 4344]. An alternative is the identification of optimal protease cleavage sequences by phage display [Matthews, D., et al. (1993) Science, 260: 1113]. Constructs is made with variant sequences and assayed for XTEN release using standard assays for detection of the XTEN polypeptides.

Example 35

Integration of XTEN Internal to the CF Sequence

Internal XTEN Fusion into the KNSADK Loop (SEQ ID NO: 621)

An FIX-XTEN fusion protein consisting of an XTEN protein inserted into a loop of FIX can be created, as depicted in FIG. 2F. Specifically, the XTEN sequence is inserted as a fusion into the KNSADNK loop (SEQ ID NO: 622) of the EGF2 domain (residues 146-152), which has no known hemophilia B mutations and is not highly structured in the FIX crystal structure. In this case, the insertion is made by dividing the native sequence at the SA bond of the loop sequence and fusing the XTEN sequence into the gap. This would give rise to a loop sequence KNS-XTEN-ADNK ('ADNK' disclosed as SEQ ID NO: 623). In a desirable feature of the inventive composition, this creates a situation where FIX-XTEN would remain intact as a pro-drug until activation of coagulation, at which time the molecule is processed to produce FIXa-XTEN, which reconstitutes or augments clotting function in a subject in need thereof.

Internal XTEN Fusion into the LAEN Loop (SEQ ID NO: 624)

An FIX-XTEN fusion protein consisting of an XTEN protein inserted into a loop of FIX can be created, as depicted in FIG. 2F. Specifically, the XTEN sequence is inserted as a fusion into the LAEN loop (SEQ ID NO: 624) of the EGF2 domain (residues 163-166), which has no known hemophilia B mutations and is not highly structured in the FIX crystal structure. In this case, the insertion is made by dividing the native sequence at the AE bond of the sequence and fusing the XTEN sequence into the gap. This would give rise to a loop sequence LA-XTEN-EN. In a desirable feature of the inventive composition, this creates a situation where FIX-XTEN would remain intact as a pro-drug until activation of coagulation, at which time the molecule is processed to produce FIXa-XTEN, which reconstitutes or augments clotting function in a subject in need thereof.

Internal XTEN Fusion into the Activation Peptide

Figure 4:
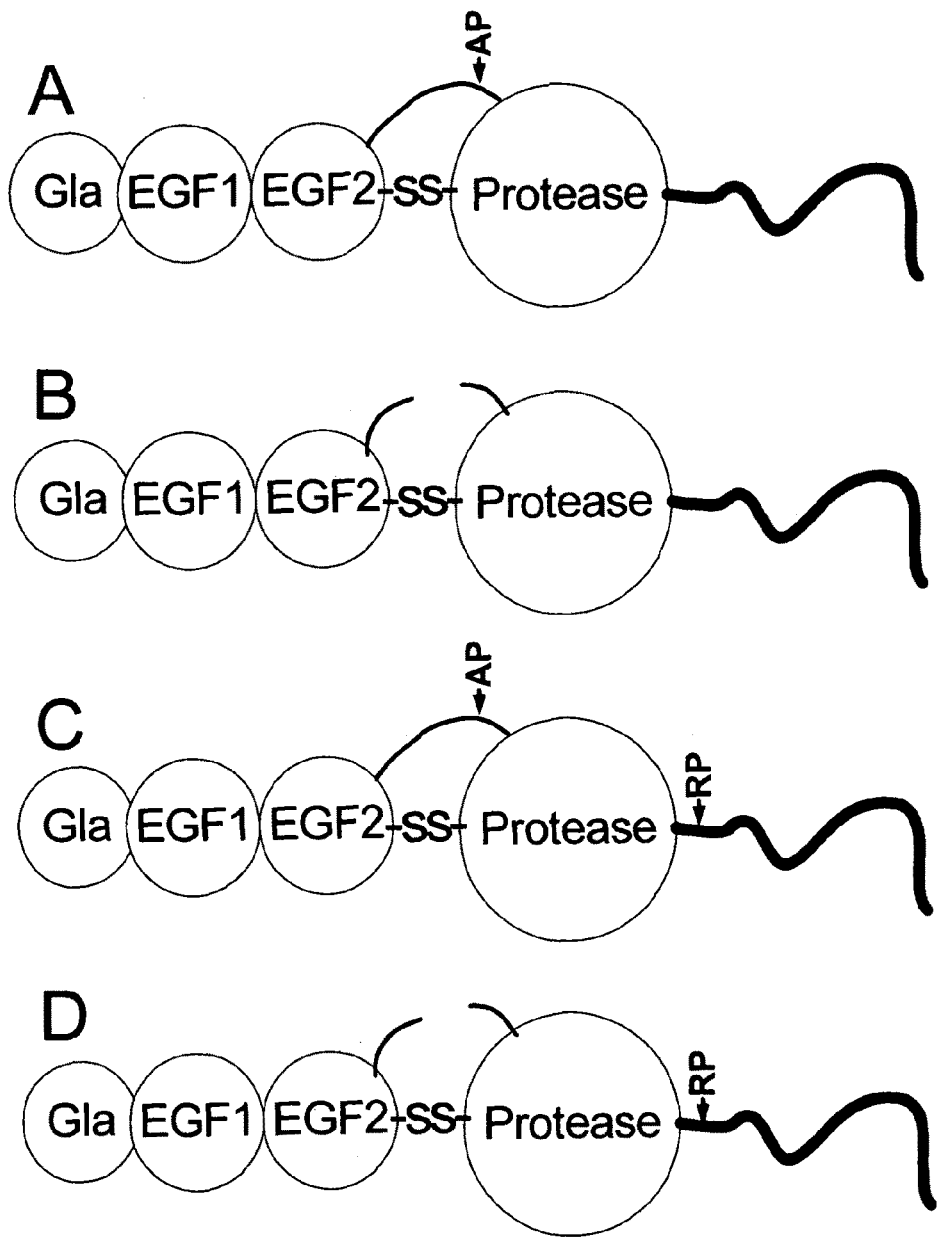
FIG. 4 shows several examples of CXTEN configurations of FVII-XTEN.

An FIX-XTEN fusion protein consisting of an XTEN protein inserted into a loop of FIX can be created, as depicted in FIG. 2D. Specifically, the XTEN fusion is placed into the activation peptide (residues 192-226) such that neither of the two native FXIa cleavage sites is disrupted. The insertion is made by dividing the native sequence at the T209-I210 bond of the sequence and fusing the XTEN sequence into the gap. This gives rise to a sequence starting at residue 188 of KLTRAETVFPDVDYVNSTEAET-XTEN-ILD-NITQSTQSFNDFTRVVGGE (SEQ ID NOS 625 and 626, respectively). FXI is the pro-coagulant protease located immediately before FIX in the intrinsic or contact activated coagulation pathway. Active FXIa is produced from FXI by proteolytic cleavage of the zymogen by FXIIa. Once activated its natural role in coagulation is to activate FIX (FIG. 4) by excising the activation peptide from the FIX zymogen by cutting the protein at positions R191 and R226. These cuts sites are depicted by arrows and the sequences are designed to leave the P4-P4' sites unaltered to allow for natural cleavage activity during the coagulation cascade. Therefore the XTEN domain would only be removed from FIX as part of the normal activation process within the intrinsic coagulation pathway.

Internal XTEN Fusion in Between the FIX EGF Domains

An FIX-XTEN fusion protein consisting of an XTEN protein inserted into a loop of FIX can be created, as depicted in FIG. 2C. Specifically, the XTEN fusion is placed in between the two EGF like domains of FIX (junction is between residues 129 and 130). The insertion is made by dividing the native sequence at the E129-L130 bond and fusing the XTEN sequence into the gap. This would give rise to a sequence starting at residue 121 of FGFEGKNCE-XTEN-LDVTCNI-KNGR (SEQ ID NOS 627 and 628, respectively). Practically, this creates a situation where FIX-XTEN would circulate intact until activation of coagulation, at which time the molecule is processed to produce FIXa-XTEN, which reconstitutes or augments clotting function in an individual.

Example 36

Human Clinical Trial Designs for Evaluating CFXTEN Comprising FVIIa

NovoSeven® is recombinant human coagulation factor VIIa (rFVIIa), intended for promoting hemostasis by activating the extrinsic pathway of the coagulation cascade. Due to its short half-life, NovoSeven is dosed intravenously from every 2 to every 6 hours until hemostasis is achieved. Fusion of XTEN to FVII improves the half-life of the protein, thus enabling a reduced dosing frequency using such FVII-containing fusion protein compositions.

Clinical trials can be designed such that the efficacy and advantages of FVIIa-XTEN, relative to NovoSeven, can be verified in humans. For example, the FVIIa-XTEN, can be used in clinical trials for treatment of bleeding as performed for NovoSeven. Such studies would comprise three phases. First, a Phase I safety and pharmacokinetics study in adult patients is conducted to determine the maximum tolerated dose and pharmacokinetics and pharmacodynamics in humans (either normal subjects or patients with hemophilia), as well as to define potential toxicities and adverse events to be tracked in future studies. The study is conducted in which single rising doses of FVIIa-XTEN compositions is administered and biochemical, PK, and clinical parameters is measured. This would permit the determination of the maximum tolerated dose and establish the threshold and maximum concentrations in dosage and circulating drug that constitute the therapeutic window for the respective components. Thereafter, clinical trials is conducted in patients with the disease, disorder or condition.

Clinical trials could be conducted in patients suffering from any disease in which NovoSeven may be expected to provide clinical benefit. For example, such indications include bleeding episodes in hemophilia A or B, patients with inhibitors to factor VIII or factor IX, and in patients with acquired hemophilia, prevention of bleeding in surgical interventions or invasive procedures in hemophilia A or B patients with inhibitors to factor VIII or factor IX and in patients with acquired hemophilia, treatment of bleeding episodes in patients with congenital FVII deficiency, and prevention of bleeding in surgical interventions or invasive procedures in patients with congenital FVII deficiency. FVIIa-XTEN may also be indicated for use in additional patient populations. Parameters and clinical endpoints are measured as a function of the dosing of the fusion proteins compositions, yielding dose-ranging information on doses that is appropriate for a subsequent Phase III trial, in addition to collecting safety data related to adverse events. The PK parameters are correlated to the physiologic, clinical and safety parameter data to establish the therapeutic window and the therapeutic dose regimen for the FVII-XTEN composition, permitting the clinician to establish the appropriate dose ranges for the composition. Finally, a phase III efficacy study is conducted wherein patients is administered the FVII-XTEN composition at the dose regimen, and a positive control (such as a commercially-available NovoSeven), or a placebo is administered using a dosing schedule deemed appropriate given the pharmacokinetic and pharmacodynamic properties of the respective compositions, with all agents administered for an appropriately extended period of time to achieve the study endpoints. Parameters that are monitored include PT assay, bleeding time assay, control of bleeding episodes, or the occurrence of spontaneous bleeding episodes; parameters that is tracked relative to the placebo or positive control groups. Efficacy outcomes is determined using standard statistical methods. Toxicity and adverse event markers are also be followed in this study to verify that the compound is safe when used in the manner described.

Example 37

Human Clinical Trial Designs for Evaluating CFXTEN Comprising FIX

BeneFIX®, Coagulation Factor IX (Recombinant), is indicated for the control and prevention of hemorrhagic episodes in patients with hemophilia B (congenital factor IX deficiency or Christmas disease), including control and prevention of bleeding in surgical settings. Dosage and duration of treatment for all factor IX products depend on the severity of the factor IX deficiency, the location and extent of bleeding, and the patient's clinical condition, age and recovery of factor IX. Fusion of XTEN to FIX improves the half-life of the protein, thus enabling a reduced dosing frequency.

Clinical trials can be designed such that the efficacy and advantages of FIX-XTEN, relative to other factor IX clinical products, can be verified in humans. For example, the FIX-XTEN, can be used in clinical trials for treatment of hemorrhagic episodes as performed for Benefix. Such studies would comprise three phases. First, a Phase I safety and pharmacokinetics study in adult patients is conducted to determine the maximum tolerated dose and pharmacokinetics and pharmacodynamics in humans (either normal subjects or patients with hemophilia), as well as to define potential toxicities and adverse events to be tracked in future studies. The study is conducted in which single rising doses of FIX-XTEN compositions is administered and biochemical, PK, and clinical parameters is measured. This would permit the determination of the maximum tolerated dose and establish the threshold and maximum concentrations in dosage and circulating drug that constitute the therapeutic window for the respective components. Thereafter, clinical trials is conducted in patients with the disease, disorder or condition.

Clinical trials could be conducted in patients suffering from any disease in which factor IX may be expected to provide clinical benefit. For example, such indications include the control and prevention of hemorrhagic episodes in patients with hemophilia B (congenital factor IX deficiency or Christmas disease), including control and prevention of bleeding in surgical settings. FIX-XTEN may also be indicated for use in additional patient populations. Parameters and clinical endpoints are measured as a function of the dosing of the fusion proteins compositions, yielding dose-ranging information on doses that is appropriate for a subsequent Phase III trial, in addition to collecting safety data related to adverse events. The PK parameters are correlated to the physiologic, clinical and safety parameter data to establish the therapeutic window and the therapeutic dose regimen for the FIX-XTEN composition, permitting the clinician to establish the appropriate dose ranges for the composition. Finally, a phase III efficacy study is conducted wherein patients is administered the FIX-XTEN composition at the dose regimen, and a positive control (such as a commercially-available BeneFIX), or a placebo is administered using a dosing schedule deemed appropriate given the pharmacokinetic and pharmacodynamic properties of the respective compositions, with all agents administered for an appropriately extended period of time to achieve the study endpoints. Parameters that are monitored include aPTT assay, bleeding time assay, control of bleeding episodes, or the occurrence of spontaneous bleeding episodes; parameters that is tracked relative to the placebo or positive control groups. Efficacy outcomes is determined using standard statistical methods. Toxicity and adverse event markers are also be followed in this study to verify that the compound is safe when used in the manner described.

Example 38

Figure 35:
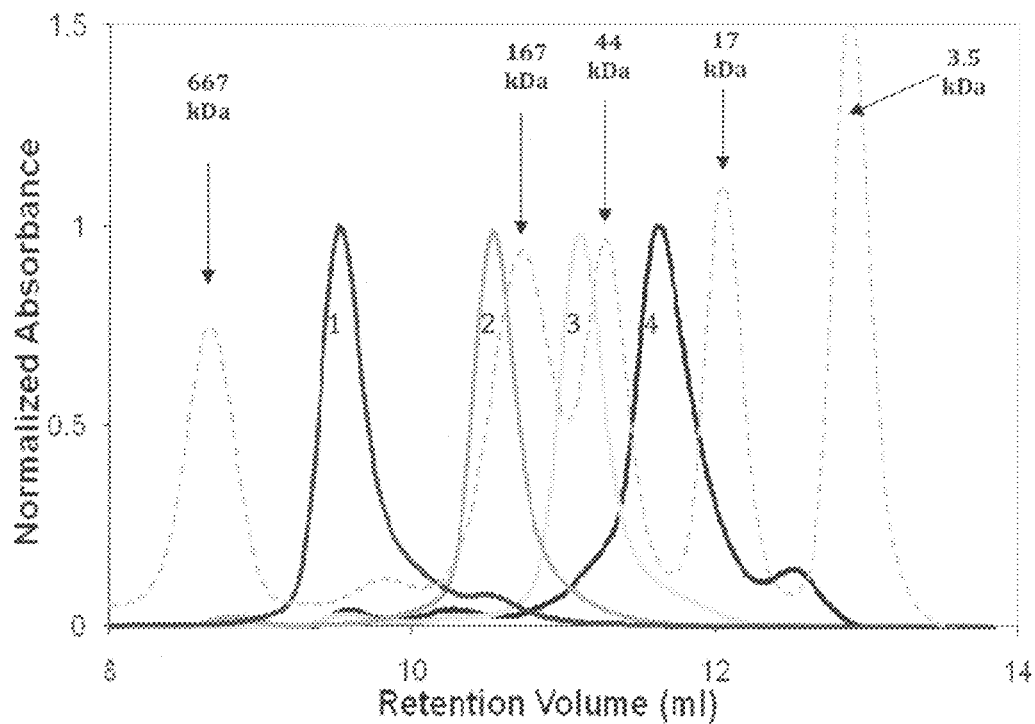
FIG. 35 shows results of a size exclusion chromatography analysis of glucagon-XTEN construct samples measured against protein standards of known molecular weight, with the graph output as absorbance versus retention volume, as described in Example 38. The glucagon-XTEN constructs are 1) glucagon-Y288; 2) glucagonY-144; 3) glucagon-Y72; and 4) glucagon-Y36. The results indicate an increase in apparent molecular weight with increasing length of XTEN moiety.

Analytical Size Exclusion Chromatography of XTEN Fusion Proteins with Diverse Payloads Size exclusion chromatography analyses were performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm. Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 35. The data show that the apparent molecular weight of each compound is proportional to the length of the attached XTEN sequence. However, the data also show that the apparent molecular weight of each construct is significantly larger than that expected for a globular protein (as shown by comparison to the standard proteins run in the same assay). Based on the SEC analyses for all constructs evaluated, including a CFXTEN composition, the apparent molecular weights, the apparent molecular weight factor (expressed as the ratio of apparent molecular weight to the calculated molecular weight) and the hydrodynamic radius ($R_H$ in nm) are shown in Table 31. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater; well beyond the glomerular pore size of approximately 3-5 nm. Accordingly, it is expected that fusion proteins comprising growth and XTEN have reduced renal clearance, contributing to increased terminal half-life and improving the therapeutic or biologic effect relative to a corresponding un-fused biologic payload protein.

TABLE 31

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
| --- | --- | --- | --- | --- | --- | --- |
| AC14 | Y288 | Glucagon | 28.7 | 370 | 12.9 | 7.0 |
| AC28 | Y144 | Glucagon | 16.1 | 117 | 7.3 | 5.0 |

TABLE 31-continued

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC398 | AE288 | FVII | 76.3 | 650 | 8.5 | 8.2 |
| AC404 | AE864 | FVII | 129 | 1900 | 14.7 | 10.1 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | CF | 100.6 | 846 | 8.4 | 8.7 |
| AC227 | AM875 | IL-1ra | 95.4 | 1103 | 11.6 | 9.2 |
| AC228 | AM1318 | IL-1ra | 134.8 | 2286 | 17.0 | 10.5 |

Example 39

Pharmacokinetics of Extended polypeptides Fused to GFP in Cynomolgus Monkeys

Figure 25:
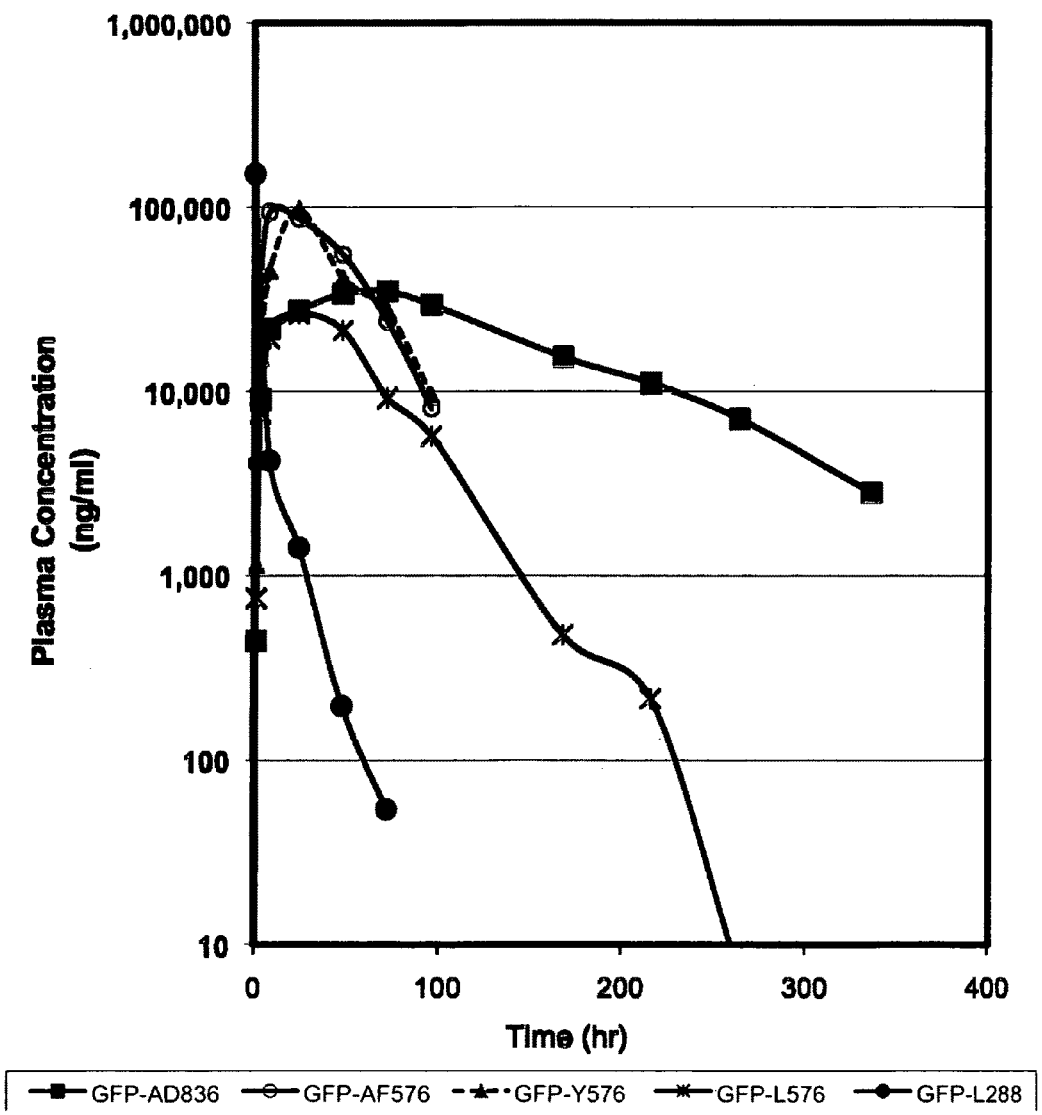
FIG. 25 shows the pharmacokinetic profile (plasma concentrations) in cynomolgus monkeys after single doses of different compositions of GFP linked to unstructured polypeptides of varying length, administered either subcutaneously or intravenously, as described in Example 39. The compositions were GFP-L288, GFP-L576, GFP-XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 25. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 40

Serum Stability of XTEN

Figure 26:
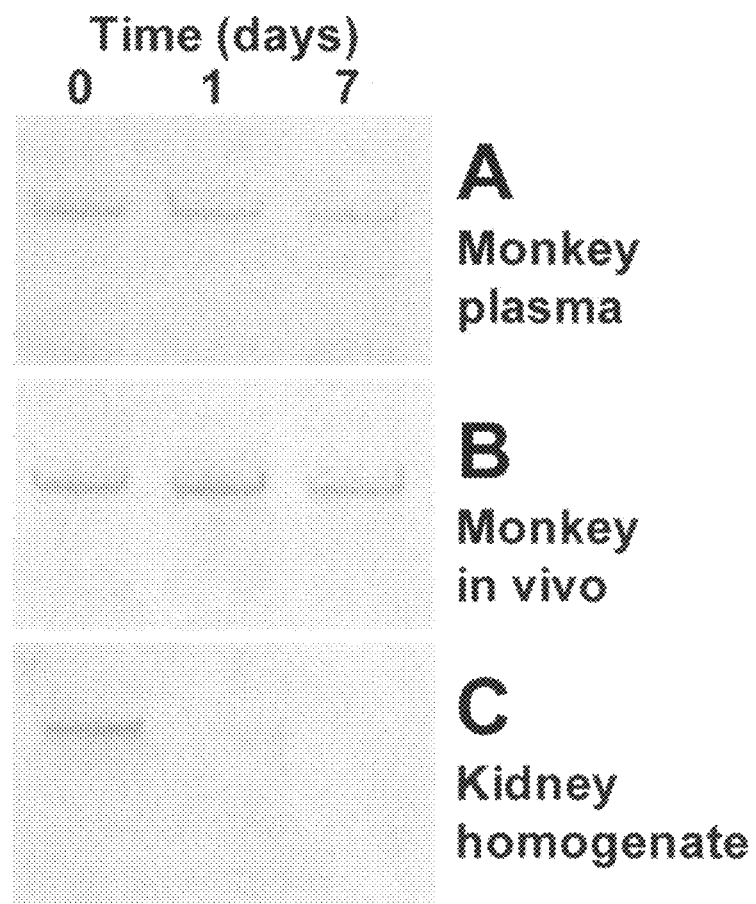
FIG. 26 shows an SDS-PAGE gel o samples from a stability study of the fusion protein of XTEN_AE864 fused to the N-terminus of GFP (see Example 40). The GFP-XTEN was incubated in cynomolgus plasma (FIG. 26A) and rat kidney lysate (FIG. 26C) for up to 7 days at 37° C. In addition, GFP-XTEN administered to cynomolgus monkeys (FIG. 26B) was also assessed. Samples were withdrawn at 0, 1 and 7 days and analyzed by SDS PAGE followed by detection using Western analysis with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 26. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of CFXTEN to degradation due to serum proteases; a factor in the enhancement of pharmacokinetic properties of the CFXTEN fusion proteins.

Example 41

Increasing Solubility and Stability of a Peptide Payload by Linking to XTEN

In order to evaluate the ability of XTEN to enhance the physical/chemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 32. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 CFX-TEN was evaluated for stability, and was found to be stable in liquid formulation for at least 6 months under refrigerated conditions and for approximately one month at 37° C. (data not shown).

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 32

Solubility of Glucagon-XTEN constructs

| Test Article | Solubility |
|---|---|
| Glucagon | 60 µM |
| Glucagon-Y36 | >370 µM |
| Glucagon-Y72 | >293 µM |
| Glucagon-AF108 | >145 µM |
| Glucagon-AF120 | >160 µM |
| Glucagon-Y144 | >497 µM |
| Glucagon-AE144 | >467 µM |
| Glucagon-AF144 | >3600 µM |
| Glucagon-Y288 | >163 µM |

Example 42

Analysis of Sequences for Secondary Structure by Prediction Algorithms

Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 33.

The results indicate that, by the Chou-Fasman calculations, the four motifs of the AE family (Table 1) have no alpha-helices or beta sheets. The sequence up to 288 residues was similarly found to have no alpha-helices or beta sheets. The 432 residue sequence is predicted to have a small amount of secondary structure, with only 2 amino acids contributing to an alpha-helix for an overall percentage of 0.5%. The full-length AF864 polypeptide has the same two amino acids contributing to an alpha-helix, for an overall percentage of 0.2%. Calculations for random coil formation revealed that with increasing length, the percentage of random coil formation increased. The first 24 amino acids of the sequence had 91% random coil formation, which increased with increasing length up to the 99.77% value for the full-length sequence.

Numerous XTEN sequences of 500 amino acids or longer from the other motif families were also analyzed and revealed that the majority had greater than 95% random coil formation. The exceptions were those sequences with one or more instances of three contiguous serine residues, which resulted in predicted beta-sheet formation. However, even these sequences still had approximately 99% random coil formation.

In contrast, a polypeptide sequence of 84 residues limited to A, S, and P amino acids was assessed by the Chou-Fasman algorithm, which predicted a high degree of predicted alpha-helices. The sequence, which had multiple repeat "AA" and "AAA" sequences, had an overall predicted percentage of alpha-helix structure of 69%. The GOR algorithm predicted 78.57% random coil formation; far less than any sequence consisting of 12 amino acid sequence motifs consisting of the amino acids G, S, T, E, P, analyzed in the present Example.

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. In contrast, polypeptides created from amino acids limited to A, S and P that have a higher degree of internal repetitiveness are predicted to have a high percentage of alpha-helices, as determined by the Chou-Fasman algorithm, as well as random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) greater than about 400 amino acid residues in length are expected to have very limited secondary structure. With the exception of motifs containing three contiguous serines, it is believed that any order or combination of sequence motifs from Table 3 can be used to create an XTEN polypeptide of a length greater than about 400 residues that will result in an XTEN sequence that is substantially devoid of secondary structure. Such sequences are expected to have the characteristics described in the CFX-TEN embodiments of the invention disclosed herein.

TABLE 33

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GSTSESPSGTAP | 629 | 12 | Residue totals*: H: 0 E: 0<br>percent: H: 0.0 E: 0.0 | Not Determined |
| | GTS TPESGSASP | 630 | 12 | Residue totals: H: 0 E: 0<br>percent: H: 0.0 E: 0.0 | Not Determined |
| | GTSPSGESSTAP | 631 | 12 | Residue totals: H: 0 E: 0<br>percent: H: 0.0 E: 0.0 | Not Determined |
| | GSTSSTAESPGP | 632 | 12 | Residue totals: H: 0 E: 0<br>percent: H: 0.0 E: 0.0 | Not Determined |
| | GSPAGSPTSTEEGTSESATPESGP | 633 | 24 | Residue totals: H: 0 E: 0<br>percent: H: 0.0 E: 0.0 | 91.67% |
| | GSPAGSPTSTEEGTSESATPESGPGTSTEPSEGSAP | 634 | 36 | Residue totals: H: 0 E: 0<br>percent: H: 0.0 E: 0.0 | 94.44% |
| | GSPAGSPTSTEEGTSESATPESGPGTSTEPSEGSAPGSPAGSPTSTEE | 635 | 48 | Residue totals: H: 0 E: 0<br>percent: H: 0.0 E: 0.0 | 93.75% |
| | GSPAGSPTSTEEGTSESATPESGPGTSTEPSEGSAPGSPAGSPTSTEEGTSTEPSEGSAP | 636 | 60 | Residue totals: H: 0 E: 0<br>percent: H: 0.0 E: 0.0 | 96.67% |
| | GSPAGSPTSTEEGTSESATPESGPGTSTEPSEGSAPGSPAGSPTSTEEGTSTEPSEGSAPGTSTEPSEGSAPGTSESATPESGPGSEPATSGSE TPGSEPATSGSETP | 637 | 108 | Residue totals: H: 0 E: 0<br>percent: H: 0.0 E: 0.0 | 97.22% |
| | GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP | 638 | 216 | Residue totals: H: 0 E: 0<br>percent: H: 0.0 E: 0.0 | 99.07% |
| | GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSESATPESGPGTSTEPSEGSAPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGSPAGSPTSTEEGTSTEPSEGSAP | 639 | 432 | Residue totals: H: 2 E: 3<br>percent: H: 0.5 E: 0.7 | 99.54% |
| AE864 | GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSE | 640 | 864 | Residue totals: H: 2 E: 3<br>percent: H: 0.2 E: 0.3 | 99.77% |

TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | SATPESGPGSEPATSGSETPGT STEPSEGSAPGTSTEPSEGSAP GTSESATPESGPGTSESATPES GPGSPAGSPTSTEEGTSESATP ESGPGSEPATSGSETPGTSESA TPESGPGTSTEPSEGSAPGTST EPSEGSAPGTSTEPSEGSAPGT STEPSEGSAPGTSTEPSEGSAP GTSTEPSEGSAPGSPAGSPTST EEGTSTEPSEGSAPGTSESATP ESGPGSEPATSGSETPGTSESA TPESGPGSEPATSGSETPGTSE SATPESGPGTSTEPSEGSAPGT SESATPESGPGSPAGSPTSTEE GSPAGSPTSTEEGSPAGSPTST EEGTSESATPESGPGTSTEPSE GSAPGTSESATPESGPGSEPAT SGSETPGTSESATPESGPGSEP ATSGSETPGTSESATPESGPGT STEPSEGSAPGSPAGSPTSTEE GTSESATPESGPGSEPATSGSE TPGTSESATPESGPGSPAGSPT STEEGSPAGSPTSTEEGTSTEP SEGSAPGTSESATPESGPGTSE SATPESGPGTSESATPESGPGS EPATSGSETPGSEPATSGSETP GSPAGSPTSTEEGTSTEPSEGS APGTSTEPSEGSAPGSEPATSG SETPGTSESATPESGPGTSTEP SEGSAP | | | | |
| AD 576 | GSSESGSSEGGPGSGGEPSES GSSGSSESGSSEGGPGSSESGS SEGGPGSSESGSSEGGPGSSES GSSEGGPGSSESGSSEGGPGE SPGGSSGSESGSSEGSSGPGESS GSSESGSSEGGPGSSESGSSEG GPGSSESGSSEGGPGSGGEPS ESGSSGESPGGSSGSESGESPG GSSGSESGSGGEPSESGSSGSS ESGSSEGGPGSGGEPSESGSS GSSGGEPSESGSSGSEGSSGPG ESSGESPGGSSGSESGSSGGEPS ESGSSGSGGEPSESGSSGSGG EPSESGSSGSSESGSSEGGPGE SPGGSSGSESGESPGGSSGSES GESPGGSSGSESGESPGGSSGS ESGESPGGSSGSESGSSESGSS EGGPGSGGEPSESGSSGSEGS SGPGESSGSSESGSSEGGPGSG GEPSESGSSGSSESGSSEGGPG SGGEPSESGSSGESPGGSSGSE SGESPGGSSGSESGSSESGSSE GGPGSGGEPSESGSSGSSESGS SEGGPGSGGEPSESGSSGSGG EPSESGSSGESPGGSSGSESGS EGSSGPGESSGSSESGSSEGGP GSEGSSGPGESS | 641 | 576 | Residue totals: H: 7 E: 0 percent: H: 1.2 E: 0.0 | 99.65% |
| AE576 | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAPGTSE SATPESGPGSEPATSGSETPGT STEPSEGSAPGTSTEPSEGSAP GTSESATPESGPGTSESATPES GPGSPAGSPTSTEEGTSESATP ESGPGSEPATSGSETPGTSESA | 642 | 576 | Residue totals: H: 2 E: 0 percent: H: 0.4 E: 0.0 | 99.65% |

TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | TPESGPGTSTEPSEGSAPGTST EPSEGSAPGTSTEPSEGSAPGT STEPSEGSAPGTSTEPSEGSAP GTSTEPSEGSAPGSPAGSPTST EEGTSTEPSEGSAPGTSESATP ESGPGSEPATSGSETPGTSESA TPESGPGSEPATSGSETPGTSE SATPESGPGTSTEPSEGSAPGT SESATPESGPGSPAGSPTSTEE GSPAGSPTSTEEGSPAGSPTST EEGTSESATPESGPGTSTEPSE GSAP | | | | |
| AF540 | GSTSSTAESPGPGSTSSTAESP GPGSTSESPSGTAPGSTSSTAE SPGPGSTSSTAESPGPGTSTPE SGSASPGSTSESPSGTAPGTSP SGESSTAPGSTSESPSGTAPGS TSESPSGTAPGTSPSGESSTAP GSTSESPSGTAPGSTSESPSGT APGTSPSGESSTAPGSTSESPS GTAPGSTSESPSGTAPGSTSES PSGTAPGTSTPESGSASPGSTS ESPSGTAPGTSTPESGSASPGS TSSTAESPGPGSTSSTAESPGP GTSTPESGSASPGTSTPESGSA SPGSTSESPSGTAPGTSTPESG SASPGTSTPESGSASPGSTSES PSGTAPGSTSESPSGTAPGSTS ESPSGTAPGSTSSTAESPGPGT STPESGSASPGTSTPESGSASP GSTSESPSGTAPGSTSESPSGT APGTSTPESGSASPGSTSESPS GTAPGSTSESPSGTAPGTSTPE SGSASPGTSPSGESSTAPGSTS STAESPGPGTSPSGESSTAPGS TSSTAESPGPGTSTPESGSASP GSTSESPSGTAP | 643 | 540 | Residue totals: H: 2 E: 0 percent: H: 0.4 E: 0.0 | 99.65 |
| AF504 | GASPGTSSTGSPGSSPSASTGT GPGSSPSASTGTGPGTPGSGT ASSSPGSSTPSGATGSPGSNPS ASTGTGPGASPGTSSTGSPGT PGSGTASSSPGSSTPSGATGSP GTPGSGTASSSPGASPGTSST GSPGASPGTSSTGSPGTPGSG TASSSPGSSTPSGATGSPGASP GTSSTGSPGTPGSGTASSSPGS STPSGATGSPGSNPSASTGTG PGSSPSASTGTGPGSSTPSGAT GSPGSSTPSGATGSPGASPGTS STGSPGASPGTSSTGSPGASPG TSSTGSPGTPGSGTASSSPGAS PGTSSTGSPGASPGTSSTGSPG ASPGTSSTGSPGSSPSASTGTG PGTPGSGTASSSPGASPGTSST GSPGASPGTSSTGSPGASPGTS STGSPGSSTPSGATGSPGSSTP SGATGSPGASPGTSSTGSPGT PGSGTASSSPGSSTPSGATGSP GSSTPSGATGSPGSSTPSGAT GSPGSSPSASTGTGPGASPGTS STGSP | 644 | 504 | Residue totals: H: 0 E: 0 percent: H: 0.0 E: 0.0 | 94.44% |
| AE864 | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAPGTSE | 645 | 864 | Residue totals: H: 2 E: 3 percent: H: 0.2 E: 0.4 | 99.77% |

… TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | SATPESGPGSEPATSGSETPGT STEPSEGSAPGTSTEPSEGSAP GTSESATPESGPGTSESATPES GPGSPAGSPTSTEEGTSESATP ESGPGSEPATSGSETPGTSESA TPESGPGTSTEPSEGSAPGTST EPSEGSAPGTSTEPSEGSAPGT STEPSEGSAPGTSTEPSEGSAP GTSTEPSEGSAPGSPAGSPTST EEGTSTEPSEGSAPGTSESATP ESGPGSEPATSGSETPGTSESA TPESGPGSEPATSGSETPGTSE SATPESGPGTSTEPSEGSAPGT SESATPESGPGSPAGSPTSTEE GSPAGSPTSTEEGSPAGSPTST EEGTSESATPESGPGTSTEPSE GSAPGTSESATPESGPGSEPAT SGSETPGTSESATPESGPGSEP ATSGSETPGTSESATPESGPGT STEPSEGSAPGSPAGSPTSTEE GTSESATPESGPGSEPATSGSE TPGTSESATPESGPGSPAGSPT STEEGSPAGSPTSTEEGTSTEP SEGSAPGTSESATPESGPGTSE SATPESGPGTSESATPESGPGS EPATSGSETPGSEPATSGSETP GSPAGSPTSTEEGTSTEPSEGS APGTSTEPSEGSAPGSEPATSG SETPGTSESATPESGPGTSTEP SEGSAP | | | | |
| AF864 | GSTSESPSGTAPGTSPSGESST APGSTSESPSGTAPGSTSESPS GTAPGTSTPESGSASPGTSTPE SGSASPGTSTESPSGTAPGSTS ESPSGTAPGTSPSGESSTAPGS TSESPSGTAPGTSPSGESSTAP GTSPSGESSTAPGTSSTAESP GPGTSPSGESSTAPGTSPSGES STAPGTSSTAESPGPGTSTPE SGSASPGTSTPESGSASPGSTS ESPSGTAPGSTSESPSGTAPGT STPESGSASPGTSSTAESPGP GTSTPESGSASPGTSESPSGT APGTSPSGESSTAPGTSSTAE SPGPGTSPSGESSTAPGTSTPE SGSASPGTSSTAESPGPGSTS STAESPGPGTSSTAESPGPGS TSSTAESPGPGTSPSGESSTAP GSTSESPSGTAPGTSESPSGT APGTSTPESGPXXXGASASGA PSTXXXXSESPSGTAPGSTSES PSGTAPGSTSESPSGTAPGSTS ESPSGTAPGSTSESPSGTAPGS TSESPSGTAPGTSTPESGSASP GTSPSGESSTAPGTSPSGESST APGSTSSTAESPGPGTSPSGES STAPGTSTPESGSASPGSTSES PSGTAPGSTSESPSGTAPGTSP SGESSTAPGSTSESPSGTAPGT STPESGSASPGTSTPESGSASP GSTSESPSGTAPGTSTPESGSA SPGSTSSTAESPGPGSTSESPS GTAPGSTSESPSGTAPGTSPSG ESSTAPGSTSSTAESPGPGTSP SGESSTAPGTSTPESGSASPGT SPSGESSTAPGTSPSGESSTAP GTSPSGESSTAPGTSSTAESP GPGSTSSTAESPGPGTSPSGES STAPGSSPSASTGTGPGSSTPS GATGSPGSSTPSGATGSP | 646 | 875 | Residue totals: H: 2 E: 0 percent: H: 0.2 E: 0.0 | 95.20% |
| AG864 | GGSPGASPGTSSTGSPGSSPSA STGTGPGSSPSASTGTGPGTP | 647 | 868 | Residue totals: H: 0 E: 0 percent: H: 0.0 E: 0.0 | 94.70% |

TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GSGTASSSPGSSTPSGATGSPG SNPSASTGTGPGASPGTSSTG SPGTPGSGTASSSPGSSTPSGA TGSPGTPGSGTASSSPGASPG TSSTGSPGASPGTSSTGSPGTP GSGTASSSPGSSTPSGATGSPG ASPGTSSTGSPGTPGSGTASSS PGSSTPSGATGSPGSNPSASTG TGPGSSPSASTGTGPGSSTPSG ATGSPGSSTPSGATGSPGASP GTSSTGSPGASPGTSSTGSPG ASPGTSSTGSPGTPGSGTASSS PGASPGTSSTGSPGASPGTSST GSPGASPGTSSTGSPGSSPSAS TGTGPGTPGSGTASSSPGASP GTSSTGSPGASPGTSSTGSPG ASPGTSSTGSPGSSTPSGATGS PGSSTPSGATGSPGASPGTSST GSPGTPGSGTASSSPGSSTPSG ATGSPGSSTPSGATGSPGSSTP SGATGSPGSSPSASTGTGPGA SPGTSSTGSPGASPGTSSTGSP GTPGSGTASSSPGASPGTSST GSPGASPGTSSTGSPGASPGTS STGSPGASPGTSSTGSPGTPGS GTASSSPGSSTPSGATGSPGTP GSGTASSSPGSSTPSGATGSPG TPGSGTASSSPGSSTPSGATGS PGSSTPSGATGSPGSSPSASTG TGPGSSPSASTGTGPGASPGT SSTGSPGTPGSGTASSSPGSST PSGATGSPGSSPSASTGTGPGS SPSASTGTGPGASPGTSSTGSP GASPGTSSTGSPGSSTPSGAT GSPGSSPSASTGTGPGASPGTS STGSPGSSPSASTGTGPGTPGS GTASSSPGSSTPSGATGSPGSS TPSGATGSPGASPGTSSTGSP | | | | |
| AM875 | GTSTEPSEGSAPGSEPATSGSE TPGSPAGSPTSTEEGSTSSTAE SPGPGTSTPESGSASPGSTSES PSGTAPGSTSESPSGTAPGTST PESGSASPGTSTPESGSASPGS EPATSGSETPGTSESATPESGP GSPAGSPTSTEEGTSTEPSEGS APGTSESATPESGPGTSTEPSE GSAPGTSTEPSEGSAPGSPAG SPTSTEEGTSTEPSEGSAPGTS TEPSEGSAPGTSESATPESGPG TSESATPESGPGTSTEPSEGSA PGTSTEPSEGSAPGTSESATPE SGPGTSTEPSEGSAPGSEPATS GSETPGSPAGSPTSTEEGSSTP SGATGSPGTPGSGTASSSPGSS TPSGATGSPGTSTEPSEGSAPG TSTEPSEGSAPGSEPATSGSET PGSPAGSPTSTEEGSPAGSPTS TEEGTSTEPSEGSAPGASASG APSTGGTSESATPESGPGSPA GSPTSTEEGSPAGSPTSTEEGS TSSTAESPGPGSTSESPSGTAP GTSPSGESSTAPGTPGSGTASS SPGSSTPSGATGSPGSSPSAST GTGPGSEPATSGSETPGTSES ATPESGPGSEPATSGSETPGST SSTAESPGPGSTSSTAESPGPG TSPSGESSTAPGSEPATSGSET PGSEPATSGSETPGTSTEPSEG SAPGTSSTAESPGPGTSTPES GSASPGTSESPSGTAPGTSTE PSEGSAPGTSTEPSEGSAPGTS TEPSEGSAPGSSTPSGATGSPG SSPSASTGTGPGASPGTSSTGS | 648 | 875 | Residue totals: H: 7 E: 3 percent: H: 0.8 E: 0.3 | 98.63% |

TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
|  | PGSEPATSGSETPGTSESATPE SGPGSPAGSPTSTEEGSSTPSG ATGSPGSSPSASTGTGPGASP GTSSTGSPGTSESATPESGPGT STEPSEGSAPGTSTEPSEGSAP |  |  |  |  |
| AM1318 | GTSTEPSEGSAPGSEPATSGSE TPGSPAGSPTSTEEGSTSSTAE SPGPGTSTPESGSASPGSTSES PSGTAPGSTSESPSGTAPGTST PESGSASPGTSTPESGSASPGS EPATSGSETPGTSESATPESGP GSPAGSPTSTEEGTSTEPSEGS APGTSESATPESGPGTSTEPSE GSAPGTSTEPSEGSAPGSPAG SPTSTEEGTSTEPSEGSAPGTS TEPSEGSAPGTSESATPESGPG TSESATPESGPGTSTEPSEGSA PGTSTEPSEGSAPGTSESATPE SGPGTSTEPSEGSAPGSEPATS GSETPGSPAGSPTSTEEGSSTP SGATGSPGTPGSGTASSSPGSS TPSGATGSPGTSTEPSEGSAPG TSTEPSEGSAPGSEPATSGSET PGSPAGSPTSTEEGSPAGSPTS TEEGTSTEPSEGSAPGPEPTGP APSGGSEPATSGSETPGTSESA TPESGPGSPAGSPTSTEEGTSE SATPESGPGSPAGSPTSTEEGS PAGSPTSTEEGTSESATPESGP GSPAGSPTSTEEGSPAGSPTST EEGSTSSTAESPGPGSTSESPS GTAPGTSPSGESSTAPGSTSES PSGTAPGSTSESPSGTAPGTSP SGESSTAPGTSTEPSEGSAPGT SESATPESGPGTSESATPESGP GSEPATSGSETPGTSESATPES GPGTSESATPESGPGTSTEPSE GSAPGTSESATPESGPGTSTEP SEGSAPGTSPSGESSTAPGTSP SGESSTAPGTSPSGESSTAPGT STEPSEGSAPGSPAGSPTSTEE GTSTEPSEGSAPGSSPSASTGT GPGSSTPSGATGSPGSSTPSGA TGSPGSSTPSGATGSPGSSTPS GATGSPGASPGTSSTGSPGAS ASGAPSTGGTSPSGESSTAPG STSSTAESPGPGTSPSGESSTA PGTSESATPESGPGTSTEPSEG SAPGTSTEPSEGSAPGSSPSAS TGTGPGSSTPSGATGSPGASP GTSSTGSPGTSTPESGSASPGT SPSGESSTAPGTSPSGESSTAP GTSESATPESGPGSEPATSGSE TPGTSTEPSEGSAPGSTSESPS GTAPGSTSESPSGTAPGTSTPE SGSASPGSPAGSPTSTEEGTSE SATPESGPGTSTEPSEGSAPGS PAGSPTSTEEGTSESATPESGP GSEPATSGSETPGSSTPSGATG SPGASPGTSSTGSPGSSTPSGA TGSPGSTSESPSGTAPGTSPSG ESSTAPGTSSTAESPGPGSST PSGATGSPGASPGTSSTGSPG TPGSGTASSSPGSPAGSPTSTE EGSPAGSPTSTEEGTSTEPSEG SAP | 649 | 1318 | Residue totals: H: 7 E: 0 percent: H: 0.7 E: 0.0 | 99.17% |
| AM923 | MAEPAGSPTSTEEGASPGTSS TGSPGSSTPSGATGSPGSSTPS GATGSPGTSTEPSEGSAPGSEP ATSGSETPGSPAGSPTSTEEGS TSSTAESPGPGTSTPESGSASP GSTSESPSGTAPGSTSESPSGT | 650 | 924 | Residue totals: H: 4 E: 3 percent: H: 0.4 E: 0.3 | 98.70% |

TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | APGTSTPESGSASPGTSTPESG SASPGSEPATSGSETPGTSESA TPESGPGSPAGSPTSTEEGTST EPSEGSAPGTSESATPESGPGT STEPSEGSAPGTSTEPSEGSAP GSPAGSPTSTEEGTSTEPSEGS APGTSTEPSEGSAPGTSESATP ESGPGTSESATPESGPGTSTEP SEGSAPGTSTEPSEGSAPGTSE SATPESGPGTSTEPSEGSAPGS EPATSGSETPGSPAGSPTSTEE GSSTPSGATGSPGTPGSGTAS SSPGSSTPSGATGSPGTSTEPS EGSAPGTSTEPSEGSAPGSEPA TSGSETPGSPAGSPTSTEEGSP AGSPTSTEEGTSTEPSEGSAPG ASASGAPSTGGTSESATPESG PGSPAGSPTSTEEGSPAGSPTS TEEGSTSSTAESPGPGTSTSESP SGTAPGTSPSGESSTAPGTPGS GTASSSPGSSTPSGATGSPGSS PSASTGTGPGSEPATSGSETPG TSESATPESGPGSEPATSGSET PGSTSSTAESPGPGTSSTAES PGPGTSPSGESSTAPGSEPATS GSETPGSEPATSGSETPGTSTE PSEGSAPGTSSTAESPGPGTS TPESGSASPGSTSESPSGTAPG TSTEPSEGSAPGTSTEPSEGSA PGTSTEPSEGSAPGSSTPSGAT GSPGSSPSASTGTGPGASPGTS STGSPGSEPATSGSETPGTSES ATPESGPGSPAGSPTSTEEGSS TPSGATGSPGSSPSASTGTGP GASPGTSSTGSPGTSESATPES GPGTSTEPSEGSAPGTSTEPSE GSAP | | | | |
| AE912 | MAEPAGSPTSTEEGTPGSGTA SSSPGSSTPSGATGSPGASPGT SSTGSPGSPAGSPTSTEEGTSE SATPESGPGTSTEPSEGSAPGS PAGSPTSTEEGTSTEPSEGSAP GTSTEPSEGSAPGTSESATPES GPGSEPATSGSETPGSEPATSG SETPGSPAGSPTSTEEGTSESA TPESGPGTSTEPSEGSAPGTST EPSEGSAPGSPAGSPTSTEEGT STEPSEGSAPGTSTEPSEGSAP GTSESATPESGPGTSTEPSEGS APGTSESATPESGPGSEPATSG SETPGTSTEPSEGSAPGTSTEP SEGSAPGTSESATPESGPGTSE SATPESGPGSPAGSPTSTEEGT SESATPESGPGSEPATSGSETP GTSESATPESGPGTSTEPSEGS APGTSTEPSEGSAPGTSTEPSE GSAPGTSTEPSEGSAPGTSTEP SEGSAPGTSTEPSEGSAPGSPA GSPTSTEEGTSTEPSEGSAPGT SESATPESGPGSEPATSGSETP GTSESATPESGPGSEPATSGSE TPGTSESATPESGPGTSTEPSE GSAPGTSESATPESGPGSPAG SPTSTEEGSPAGSPTSTEEGSP AGSPTSTEEGTSESATPESGPG TSTEPSEGSAPGTSESATPESG PGSEPATSGSETPGTSESATPE SGPGSEPATSGSETPGTSESAT PESGPGTSTEPSEGSAPGSPAG SPTSTEEGTSESATPESGPGSE PATSGSETPGTSESATPESGPG SPAGSPTSTEEGSPAGSPTSTE EGTSTEPSEGSAPGTSESATPE | 651 | 913 | Residue totals: H: 8 E: 3 percent: H: 0.9 E: 0.3 | 99.45% |

TABLE 33-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | SGPGTSESATPESGPGTSESAT PESGPGSEPATSGSETPGSEPA TSGSETPGSPAGSPTSTEEGTS TEPSEGSAPGTSTEPSEGSAPG SEPATSGSETPGTSESATPESG PGTSTEPSEGSAP | | | | |
| BC 864 | GTSTEPSEPGSAGTSTEPSEPG SAGSEPATSGTEPSGSGASEPT STEPGSEPATSGTEPSGSEPAT SGTEPSGSEPATSGTEPSGSGA SEPTSTEPGTSTEPSEPGSAGS EPATSGTEPSGTSTEPSEPGSA GSEPATSGTEPSGSEPATSGTE PSGTSTEPSEPGSAGTSTEPSE PGSAGSEPATSGTEPSGSEPAT SGTEPSGTSEPSTSEPGAGSGA SEPTSTEPGTSEPSTSEPGAGS EPATSGTEPSGSEPATSGTEPS GTSTEPSEPGSAGTSTEPSEPG SAGSGASEPTSTEPGSEPATSG TEPSGSEPATSGTEPSGSEPAT SGTEPSGSEPATSGTEPSGTST EPSEPGSAGSEPATSGTEPSGS GASEPTSTEPGTSTEPSEPGSA GSEPATSGTEPSGSGASEPTST EPGTSTEPSEPGSAGSGASEPT STEPGSEPATSGTEPSGSGASE PTSTEPGSEPATSGTEPSGSGA SEPTSTEPGTSTEPSEPGSAGS EPATSGTEPSGSGASEPTSTEP GTSTEPSEPGSAGSEPATSGTE PSGTSTEPSEPGSAGSEPATSG TEPSGTSTEPSEPGSAGTSTEP SEPGSAGTSTEPSEPGSAGTST EPSEPGSAGTSTEPSEPGSAGT STEPSEPGSAGTSEPSTSEPGA GSGASEPTSTEPGTSTEPSEPG SAGTSTEPSEPGSAGTSTEPSE PGSAGSEPATSGTEPSGSGAS EPTSTEPGSEPATSGTEPSGSE PATSGTEPSGSEPATSGTEPSG SEPATSGTEPSGTSEPSTSEPG AGSEPATSGTEPSGSGASEPTS TEPGTSTEPSEPGSAGSEPATS GTEPSGSGASEPTSTEPGTSTE PSEPGSA | 652 | | Residue totals: H: 0 E: 0 percent: H: 0 E: 0 | 99.77% |
| | ASPAAPAPASPAAPAPSAPAA APASPAPAAPSAPAPAAPSAA SPAAPSAPPAAASPAAPSAPP AASAAAPAAASAAASAPSAAA | 653 | 84 | Residue totals: H: 58 E: 0 percent: H: 69.0 E: 0.0 | 78.57% |

*H: alpha-helix E: beta-sheet

Example 43

Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 34, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 654), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions:

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 34

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGE GGSGGEGGSGGEGGSGGEGGSGGEGGSGGEGGSGGEGGSGG EGGSGGEGGSGGEGGSGGEGGSGGEGGSGGEGGSGGEGGSG GEGGSGGEGGSGGEGGSGGEGGSGGEGGSGGEGGSGGEGGS GGEGGSGGEGGSGGEGGSGGEGGSGGEGGSGGEGGSGGEGG SGGEGGSGGEGGSGGEGGSGGEGGSGGEGGSGGEGGSGGEG GSGGEGGSGGEGGSGGEGGSGGEGGSGGEGGSGGEGGSGGE G | 655 | 33.3 |
| K288 | GEGEGGGEGGEGEGGGEGGEGEGGGEGGEGEGGGEGGEGEG GGEGGEGEGGGEGGEGEGGGEGGEGEGGGEGGEGEGGGEGG EGEGGGEGGEGEGGGEGGEGEGGGEGGEGEGGGEGGEGEGG GEGGEGEGGGEGGEGEGGGEGGEGEGGGEGGEGEGGGEGGE GEGGGEGGEGEGGGEGGEGEGGGEGGEGEGGGEGGEGEGGG EGGEGEGGGEGGEGEGGGEGGEGEGGGEGGEGEGGGEGGEG EGGGEGGEGEGGGEGGEGEGGGEGGEGEGGGEGGEGEGGGE G | 656 | 46.9 |
| L288 | SSESSESSSSESSSESSSESSSSESSSESSSESSSSESSSESSSSESS SESSESSSSESSSESSSESSSSESSSESSSESSSSESSSESSSSESSS ESSESSSSESSSESSSESSSSESSSESSSESSSSESSSESSSSESSSE SSESSSSESSSESSSESSSSESSSESSSESSSSESSSESSSSESSSES SESSSSESSSESSSESSSSESSSESSSESSSSESSSESSSSESSSESS ESSSSESSSESSSESSSSESSSESSSESSSSESSSESSSSSES | 657 | 50.0 |
| Y288 | GEGSGEGSEGEGSEGSGEGEGSEGSGEGEGGSEGSEGEGGSEG SEGEGGSEGSEGEGSGEGSEGEGGSEGSEGEGSGEGSEGEGSE GGSEGEGGSEGSEGEGSGEGSEGEGGEGGSEGEGSEGSGEGEG SGEGSEGEGSEGSGEGEGSGEGSEGEGSEGSGEGEGSEGSGEG EGGSEGSEGEGSEGSGEGGEGSGEGEGSGEGSEGEGGGEGS EGEGSGEGGEGEGSEGGSEGEGGSEGGEGEGSEGSGEGEGSE GGSEGEGSEGGSEGEGSEGSGEGEGSEGSGE | 658 | 26.8 |
| Q576 | GGKPGEGGKPEGGGGKPGGKPEGEGEGKPGGKPEGGGKPGG GEGGKPEGGKPEGEGKPGGGEGKPGGKPEGGGKPEGEGKP GGGGGKPGGKPEGEGKPGGGEGGKPEGKPGEGGEGKPGGKP EGGGEGKPGGGKPGEGGKPGEGKPGGGEGGKPEGGKPEGEG KPGGGEGKPGGKPGEGGKPEGGGEGKPGGKPEGGEGKPGG GKPEGEGKPGGGKPGGGEGGKPEGEGKPGGKPEGGGEGKPG GKPEGGGKPEGGGEGKPGGGKPGEGGKPGEGEGKPGGKPEG EGKPGGEGGGKPEGKPGGGEGGKPEGGKPGEGGKPEGGKPG EGGEGKPGGGKPGEGGKPEGGGKPEGEGKPGGGGKPGEGGK PEGGKPEGGGEGKPGGGKPEGEGKPGGGEGKPGGKPEGGGG KPGEGGKPEGGKPGEGGGKPEGEGKPGGKPGEGGGGKPGG KPEGEGKPGEGGEGKPGGKPEGGGEGKPGGKPEGGGEGKPG GGKPGEGGKPEGGGKPGEGGKPGEGGKPEGEGKPGGGEGKP GGKPGEGGKPEGGGEGKPGGKPGGEGGGKPEGGKPGEGGKP EG | 659 | 18.5 |
| U576 | GEGKPGGKPGSGGGKPGEGGKPGSGEGKPGGKPGSGGSGKP GGKPGEGGKPEGGSGGKPGGGGKPGGKPGGEGSGKPGGKPE GGGKPEGGSGGKPGGKPEGGSGGKPGGKPGSGEGGKPGGGK PGGEGKPGSGKPGGEGSGKPGGKPEGGSGGKPGGKPEGGSGG KPGGSGKPGGKPGEGGKPEGGSGGKPGGSGKPGGKPEGGGS GKPGGKPGEGGKPGSGEGKPGGGKPGGEGKPGSGKPGGEG SGKPGGKPGSGGEGKPGGKPEGGSGGKPGGGKPGGEGKPGS GGKPGEGGKPGSGGGKPGGKPGGEGEGKPGGKPGEGGKPGG | 660 | 18.1 |

TABLE 34-continued

Subsequence score calculations of polypeptide sequences

| Seq Name | Amino Acid Sequence | SEQ ID NO: | Score |
|---|---|---|---|
| | EGSGKPGGGGKPGGKPGGEGGKPEGSGKPGGGSGKPGGKPE GGGGKPEGSGKPGGGGKPEGSGKPGGGKPEGGSGGKPGGSG KPGGKPGEGGGKPEGSGKPGGGSGKPGGKPEGGGKPEGGSG GKPGGKPEGGSGGKPGGKPGGEGSGKPGGKPGSGEGGKPGG KPGEGSGGKPGGKPEGGSGGKPGGSGKPGGKPEGGGSGKPG GKPGEGGKPGGEGSGKPGGSGKPG | | |
| W576 | GGSGKPGKPGGSGSGKPGSGKPGGGSGKPGSGKPGGGSGKPG SGKPGGGSGKPGSGKPGGGGKPGSGSGKPGGGKPGGSGGKP GGGSGKPGKPGSGGSGKPGSGKPGGGSGGKPGKPGSGGSGG KPGKPGSGGGSGKPGKPGSGGSGGKPGKPGSGGGGKPGKPG SGGSGKPGSGKPGGGSGKPGSGKPGSGGSGKPGKPGSGGSGK PGSGKPGSGSGKPGSGKPGGGSGKPGSGKPGSGGSGKPGKPG SGGGKPGSGSGKPGGGKPGSGSGKPGGGKPGGSGGKPGGSG GKPGKPGSGGGSGKPGKPGSGGGSGKPGKPGGSGSGKPGSGK PGGGSGKPGSGKPGSGGSGKPGKPGSGGGGK PGSGSGKPGGGKPGSGSGKPGGGKPGSGSGKPGGGKPGSGSG KPGGSGKPGSGKPGGGSGGKPGKPGSGGSGKPGSGKPGSGGS GKPGKPGGSGSGKPGSGKPGGGSGKPGSGKPGGGGKPGSGK PGGSGGKPGKPGSGGSG GKPGKPGSGGSGKPGSGKPGGGSGGKPGKPGSGG | 661 | 23.4 |
| Y576 | GEGSGEGSEGEGSEGSGEGEGSEGSGEGEGGSEGSEGEGSEGS GEGEGGEGSGEGEGSGEGSEGGGEGSEGEGSGEGGEGEGS EGGSEGEGGSEGGEGEGSEGSGEGEGSEGGSEGEGSEGGSEGE GSEGSGEGEGSEGSGEGEGSEGSGEGEGSEGGSE GEGGSEGSEGEGGSEGSEGEGGSEGSEGEGGGEGSEGEGSGEG SEGEGGSEGSEGEGGSEGSGEGEGGSEGSGEGEGSEGSGEGSG EGSEGEGSEGSGEGEGSEGSGEGEGGSEGSEGEGSGEGSEGEG SEGSGEGEGGSEGSEGEGGSEGSGEGEGGSEGSEG EGGEGSGEGEGSEGSGEGEGSGEGSEGEGSEGSGEGEGSEGSG EGEGGSEGSEGEGSGEGSGEGEGGEGSGEGEGSGEGSEGEGGG EGSEGEGSEGSGEGEGSEGSGEGEGSEGGSEGEGGSEGSEGEG SEGGSEGEGSEGSGEGEGSEGSGEGEGSGEGSEG EGGSEGGEGEGSEGGSEGEGSEGGSEGEGGEGSGEGEGGGEG SEGEGSEGSGEGEGSGEGSE | 662 | 15.7 |
| AD576 | GSSESGSSEGGPGSGGEPSESGSSGSSESGSSEGGPGSSESGSSE GGPGSSESGSSEGGPGSSESGSSEGGPGESPG GSSSGSESGSEGSSGPGESSGSSESGSSEGGPGSSESGSSEGGPGS SESGSSSEGGPGSGGEPSESGSSGESPGGSSGSE SGSGGEPSESGSSGSSESGSSEGGPGSGGEPSESGSSGSGGEPSE SGSSGEGSSGPGESSGESPGGSSGSESGSGGEPSESGSSGSGGE PSESGSSGSGGEPSESGSSGSSESGSSEGGPGESPGGSSGSESGE SPGGSSGSESGESPGGSGSESGESPGGSSGSE SGSSESGSSEGGPGSGGEPSESGSGSEGSSGPGESSGSSESGSS EGGPGSGGEPSESGSSGSSESGSSEGGPGSGGEPSESGSSGESPG GSSSGSESGESPGGSSGSESGSSESGSSEGGPGSGGEPSESGSSGS SESGSSEGGPGSGGEPSESGSSGSGGEPSESGSSGESPGGSSGSE SGSEGSSGPGESSGSSESGSSEGGPGSEGSSGPGESS | 663 | 13.6 |
| AE576 | AGSPAGSPTSTEEGTSESATPESGPGTSTEPSEGSAPGSPAGSPT STEEGTSTEPSEGSAPGTSTEPSEGSAPGTSESATPESGPGSEPA TSGSETPGSEPATSGSETPGSPAGSPTSTEEGTSESATPESGPGT STEPSEGSAPGTSTEPSEGSAPGSPAGSPTSTEEGTSTEPSEGSA PGTSTEPSEGSAPGTSESATPESGPGTSTEPSEGSAPGTSESATP ESGPGSEPATSGSETPGTSTEPSEGSAPGTSTEPSEGSAPGTSES ATPESGPGTSESATPESGPGSPAGSPTSTEEGTSESATPESGPGS EPATSGSETPGTSESATPESGPGTSTEPSEGSAPGTSTEPSEGSA PGTSTEPSEGSAPGTSTEPSEGSAPGTSTEPSE GSAPGSPAGSPTSTEEGTSTEPSEGSAPGTSESATPESGPGSEPA TSGSETPGTSESATPESGPGSEPATSGSETPGTSESATPESGPGT STEPSEGSAPGTSESATPESGPGSPAGSPTSTEEGSPAGSPTSTE EGSPAGSPTSTEEGTSESATPESGPGTSTEPSEGSAP | 664 | 6.1 |
| AF540 | GSTSSTAESPGPGSTSSTAESPGPGSTSESPSGTAPGSTSSTAESP GPGSTSSTAESPGPGTSTPESGSASPGSTSESPSGTAPGTSPSGE SSTAPGSTSESPSGTAPGSTSESPSGTAPGTSPSGESSTAPGSTSE SPSGTAPGSTSESPSGTAPGTSPSGESSTAPGSTSESPSGTAPGS TSESPSGTAPGSTSESPSGTAPGTSTPESGSASPGSTSESPSGTAP GTSTPESGSASPGSTSSTAESPGPGSTSSTAESPGPGTSTPESGS ASPGTSTPESGSASPGSTSESPSGTAPGTSTPESGSASPGTSTPES GSASPGSTSESPSGTAPGSTSESPSGTAPGSTSESPSGTAPGSTSS TAESPGPGTSTPESGSASPGTSTPESGSASPGSTSESPSGTAPGS | 665 | 8.8 |

TABLE 34-continued

Subsequence score calculations of polypeptide sequences

| Seq Name | Amino Acid Sequence | SEQ ID NO: | Score |
|---|---|---|---|
| | TSESPSGTAPGTSTPESGSASPGSTSESPSGTAPGSTSESPSGTAP GTSTPESGSASPGTSPSGESSTAPGSTSSTAESPGPGTSPSGESST APGSTSSTAESPGPGTSTPESGSASPGSTSESPSGTAP | | |
| AF504 | GASPGTSSTGSPGSSPSASTGTGPGSSPSASTGTGPGTPGSGTAS SSPGSSTPSGATGSPGSNPSASTGTGPGASPGTSSTGSPGTPGSG TASSSPGSSTPSGATGSPGTPGSGTASSSPGASPGTSSTGSPGAS PGTSSTGSPGTPGSGTASSSPGSSTPSGATGSPGASPGTSSTGSP GTPGSGTASSSPGSSTPSGATGSPGSNPSASTGTGPGSSPSASTG TGPGSSTPSGATGSPGSSTPSGATGSPGASPGTSSTGSPGASPGT SSTGSPGASPGTSSTGSPGTPGSGTASSSPGASPGTSSTGSPGAS PGTSSTGSPGASPGTSSTGSPGSSPSASTGTGPGTPGSGTASSSP GASPGTSSTGSPGASPGTSSTGSPGASPGTSSTGSPGSSTPSGAT GSPGSSTPSGATGSPGASPGTSSTGSPGTPGSGTASSSPGSSTPS GATGSPGSSTPSGATGSPGSSTPSGATGSPGSSPSASTGTGPGA SPGTSSTGSP | 666 | 7.0 |
| AE864 | GSPAGSPTSTEEGTSESATPESGPGTSTEPSEGSAPGSPAGSPTS TEEGTSTEPSEGSAPGTSTEPSEGSAPGTSESATPESGPGSEPAT SGSETPGSEPATSGSETPGSPAGSPTSTEEGTSESATPESGPGTS TEPSEGSAPGTSTEPSEGSAPGSPAGSPTSTEEGTSTEPSEGSAP GTSTEPSEGSAPGTSESATPESGPGTSTEPSEGSAPGTSESATPE SGPGSEPATSGSETPGTSTEPSEGSAPGTSTEPSEGSAPGTSESA TPESGPGTSESATPESGPGSPAGSPTSTEEGTSESATPESGPGSE PATSGSETPGTSESATPESGPGTSTEPSEGSAPGTSTEPSEGSAP GTSTEPSEGSAPGTSTEPSEGSAPGTSTEPSEGSAPGTSTEPSEG SAPGSPAGSPTSTEEGTSTEPSEGSAPGTSESATPESGPGSEPAT SGSETPGTSESATPESGPGSEPATSGSETPGTSESATPESGPGTS TEPSEGSAPGTSESATPESGPGSPAGSPTSTEEGSPAGSPTSTEE GSPAGSPTSTEEGTSESATPESGPGTSTEPSEGSAPGTSESATPE SGPGSEPATSGSETPGTSESATPESGPGSEPATSGSETPGTSESA TPESGPGTSTEPSEGSAPGSPAGSPTSTEEGTSESATPESGPGSE PATSGSETPGTSESATPESGPGSPAGSPTSTEEGSPAGSPTSTEE GTSTEPSEGSAPGTSESATPESGPGTSESATPESGPGTSESATPE SGPGSEPATSGSETPGSEPATSGSETPGSPAGSPTSTEEGTSTEP SEGSAP | 667 | 6.1 |
| AF864 | GSTSESPSGTAPGTSPSGESSTAPGSTSESPSGTAPGSTSESPSGT APGTSTPESGSASPGTSTPESGSASPGSTSESPSGTAPGSTSESPS GTAPGTSPSGESSTAPGSTSESPSGTAPGTSPSGESSTAPGTSPS GESSTAPGSTSSTAESPGPGTSPSGESSTAPGTSPSGESSTAPGS TSSTAESPGPGTSTPESGSASPGTSTPESGSASPGSTSESPSGTAP GSTSESPSGTAPGTSTPESGSASPGSTSSTAESPGPGTSTPESGS ASPGSTSESPSGTAPGTSPSGESSTAPGSTSSTAESPGPGTSPSG ESSTAPGTSTPESGSASPGSTSSTAESPGPGSTSSTAESPGPGSTS STAESPGPGSTSSTAESPGPGTSPSGESSTAPGSTSESPSGTAPG STSESPSGTAPGTSTPESGPXXXGASASGAPSTXXXXSESPSGT APGSTSESPSGTAPGSTSESPSGTAPGSTSESPSGTAPGSTSESPS GTAPGSTSESPSGTAPGTSTPESGSASPGTSPSGESSTAPGTSPS GESSTAPGSTSSTAESPGPGTSPSGESSTAPGTSTPESGSASPGS TSESPSGTAPGSTSESPSGTAPGTSPSGESSTAPGSTSESPSGTAP GTSTPESGSASPGTSTPESGSASPGSTSESPSGTAPGTSTPESGS ASPGSTSSTAESPGPGSTSESPSGTAPGSTSESPSGTAPGTSPSG ESSTAPGSTSSTAESPGPGTSPSGESSTAPGTSTPESGSASPGTSP SGESSTAPGTSPSGESSTAPGTSPSGESSTAPGSTSSTAESPGPG STSSTAESPGPGTSPSGESSTAPGSSPSASTGTGPGSSTPSGATG SPGSSTPSGATGSP | 668 | 7.5 |
| AG868 | GGSPGASPGTSSTGSPGSSPSASTGTGPGSSPSASTGTGPGTPGS GTASSSPGSSTPSGATGSPGSNPSASTGTGPGASPGTSSTGSPGT PGSGTASSSPGSSTPSGATGSPGTPGSGTASSSPGASPGTSSTGS PGASPGTSSTGSPGTPGSGTASSSPGSSTPSGATGSPGASPGTSS TGSPGTPGSGTASSSPGSSTPSGATGSPGSNPSASTGTGPGSSPS ASTGTGPGSSTPSGATGSPGSSTPSGATGSPGASPGTSSTGSPG ASPGTSSTGSPGASPGTSSTGSPGTPGSGTASSSPGASPGTSSTG SPGASPGTSSTGSPGASPGTSSTGSPGSSPSASTGTGPGTPGSGT ASSSPGASPGTSSTGSPGASPGTSSTGSPGASPGTSSTGSPGSST PSGATGSPGSSTPSGATGSPGASPGTSSTGSPGTPGSGTASSSPG SSTPSGATGSPGSSTPSGATGSPGSSTPSGATGSPGSSPSASTGT GPGASPGTSSTGSPGASPGTSSTGSPGTPGSGTASSSPGASPGTS STGSPGASPGTSSTGSPGASPGTSSTGSPGASPGTSSTGSPGTPG SGTASSSPGSSTPSGATGSPGTPGSGTASSSPGSSTPSGATGSPG TPGSGTASSSPGSSTPSGATGSPGSSTPSGATGSPGSSPSASTGT GPGSSPSASTGTGPGASPGTSSTGSPGTPGSGTASSSPGSSTPSG | 669 | 7.5 |

TABLE 34-continued

Subsequence score calculations of polypeptide sequences

| Seq Name | Amino Acid Sequence | SEQ ID NO: | Score |
|---|---|---|---|
| | ATGSPGSSPSASTGTGPGSSPSASTGTGPGASPGTSSTGSPGASP GTSSTGSPGSSTPSGATGSPGSSPSASTGTGPGASPGTSSTGSPG SSPSASTGTGPGTPGSGTASSSPGSSTPSGATGSPGSSTPSGATG SPGASPGTSSTGSP | | |
| AM875 | GTSTEPSEGSAPGSEPATSGSETPGSPAGSPTSTEEGSTSSTAES PGPGTSTPESGSASPGSTSESPSGTAPGSTSESPSGTAPGTSTPES GSASPGTSTPESGSASPGSEPATSGSETPGTSESATPESGPGSPA GSPTSTEEGTSTEPSEGSAPGTSESATPESGPGTSTEPSEGSAPG TSTEPSEGSAPGSPAGSPTSTEEGTSTEPSEGSAPGTSTEPSEGS APGTSESATPESGPGTSESATPESGPGTSTEPSEGSAPGTSTEPS EGSAPGTSESATPESGPGTSTEPSEGSAPGSEPATSGSETPGSPA GSPTSTEEGSSTPSGATGSPGTPGSGTASSSPGSSTPSGATGSPG TSTEPSEGSAPGTSTEPSEGSAPGSEPATSGSETPGSPAGSPTST EEGSPAGSPTSTEEGTSTEPSEGSAPGASASGAPSTGGTSESATP ESGPGSPAGSPTSTEEGSPAGSPTSTEEGSTSSTAESPGPGSTSE SPSGTAPGTSPSGESSTAPGTPGSGTASSSPGSSTPSGATGSPGS SPSASTGTGPGSEPATSGSETPGTSESATPESGPGSEPATSGSET PGSTSSTAESPGPGSTSSTAESPGPGTSPSGESSTAPGSEPATSG SETPGSEPATSGSETPGTSTEPSEGSAPGSTSSTAESPGPGTSTPE SGSASPGSTSESPSGTAPGTSTEPSEGSAPGTSTEPSEGSAPGTS TEPSEGSAPGSSTPSGATGSPGSSPSASTGTGPGASPGTSSTGSP GSEPATSGSETPGTSESATPESGPGSPAGSPTSTEEGSSTPSGAT GSPGSSPSASTGTGPGASPGTSSTGSPGTSESATPESGPGTSTEP SEGSAPGTSTEPSEGSAP | 670 | 4.5 |
| AM1318 | GTSTEPSEGSAPGSEPATSGSETPGSPAGSPTSTEEGSTSSTAES PGPGTSTPESGSASPGSTSESPSGTAPGSTSESPSGTAPGTSTPES GSASPGTSTPESGSASPGSEPATSGSETPGTSESATPESGPGSPA GSPTSTEEGTSTEPSEGSAPGTSESATPESGPGTSTEPSEGSAPG TSTEPSEGSAPGSPAGSPTSTEEGTSTEPSEGSAPGTSTEPSEGS APGTSESATPESGPGTSESATPESGPGTSTEPSEGSAPGTSTEPS EGSAPGTSESATPESGPGTSTEPSEGSAPGSEPATSGSETPGSPA GSPTSTEEGSSTPSGATGSPGTPGSGTASSSPGSSTPSGATGSPG TSTEPSEGSAPGTSTEPSEGSAPGSEPATSGSETPGSPAGSPTST EEGSPAGSPTSTEEGTSTEPSEGSAPGPEPTGPAPSGGSEPATSG SETPGTSESATPESGPGSPAGSPTSTEEGTSESATPESGPGSPAG SPTSTEEGSPAGSPTSTEEGTSESATPESGPGSPAGSPTSTEEGSP AGSPTSTEEGSTSSTAESPGPGSTSESPSGTAPGTSPSGESSTAP GSTSESPSGTAPGSTSESPSGTAPGTSPSGESSTAPGTSTEPSEGS APGTSESATPESGPGTSESATPESGPGSEPATSGSETPGTSESAT PESGPGTSESATPESGPGTSTEPSEGSAPGTSESATPESGPGTST EPSEGSAPGTSPSGESSTAPGTSPSGESSTAPGTSPSGESSTAPG TSTEPSEGSAPGSPAGSPTSTEEGTSTEPSEGSAPGSSPSASTGT GPGSSTPSGATGSPGSSTPSGATGSPGSSTPSGATGSPGSSTPSG ATGSPGASPGTSSTGSPGASASGAPSTGGTSPSGESSTAPGSTSS TAESPGPGTSPSGESSTAPGTSESATPESGPGTSTEPSEGSAPGT STEPSEGSAPGSSPSASTGTGPGSSTPSGATGSPGASPGTSSTGS PGTSTPESGSASPGTSPSGESSTAPGTSPSGESSTAPGTSESATPE SGPGSEPATSGSETPGTSTEPSEGSAPGSTSESPSGTAPGSTSESP SGTAPGTSTPESGSASPGSPAGSPTSTEEGTSESATPESGPGTST EPSEGSAPGSPAGSPTSTEEGTSESATPESGPGSEPATSGSETPG SSTPSGATGSPGASPGTSSTGSPGSSTPSGATGSPGSTSESPSGT APGTSPSGESSTAPGSTSSTAESPGPGSSTPSGATGSPGASPGTS STGSPGTPGSGTASSSPGSPAGSPTSTEEGSPAGSPTSTEEGTST EPSEGSAP | 671 | 4.5 |

Example 44

Calculation of TEPITOPE Scores

TEPITOPE scores of 9 mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 35 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 35 were added. The HLA*0101B score of a 9 mer peptide with the sequence FDKLPRTSG (SEQ ID NO: 672) is the sum of 0, −1.3, 0, 0.9, 0, −1.8, 0.09, 0, 0.

To evaluate the TEPITOPE scores for long peptides one can repeat the process for all 9 mer subsequences of the sequences. This process can be repeated for the proteins encoded by other HLA alleles. Tables 36-39 give pocket potentials for the protein products of HLA alleles that occur with high frequency in the Caucasian population.

TEPITOPE scores calculated by this method range from approximately −10 to +10. However, 9 mer peptides that lack a hydrophobic amino acid (FKLMVWY (SEQ ID NO: 673)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9 mer subsequences will have TEPITOPEs in the range in the range of −1009 to −989. This method confirms that XTEN polypeptides may have few or no predicted T-cell epitopes.

TABLE 35

Pocket potential for HLA*0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |
| F | 0 | 0.8 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |
| N | −999 | 0.8 | 0.5 | 0.04 | — | −1.1 | 0.1 | — | −1.2 |
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.1 | — | −1.4 |
| Y | 0 | 0.9 | 0.8 | −1.1 | — | −2 | 0.5 | — | −0.9 |

TABLE 36

Pocket potential for HLA*0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | −0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 37

Pocket potential for HLA*0401B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 1.4 | — | −1.1 | −0.3 | — | −1.7 |
| E | −999 | 0.1 | −1.2 | 1.5 | — | −2.4 | 0.2 | — | −1.7 |
| F | 0 | 0.8 | 0.8 | −0.9 | — | −1.1 | −1 | — | −1 |
| G | −999 | 0.5 | 0.2 | −1.6 | — | −1.5 | −1.3 | — | −1 |
| H | −999 | 0.8 | 0.2 | 1.1 | — | −1.4 | 0 | — | 0.08 |
| I | −1 | 1.1 | 1.5 | 0.8 | — | −0.1 | 0.08 | — | −0.3 |
| K | −999 | 1.1 | 0 | −1.7 | — | −2.4 | −0.3 | — | −0.3 |
| L | −1 | 1 | 1 | 0.8 | — | −1.1 | 0.7 | — | −1 |
| M | −1 | 1.1 | 1.4 | 0.9 | — | −1.1 | 0.8 | — | −0.4 |
| N | −999 | 0.8 | 0.5 | 0.9 | — | 1.3 | 0.6 | — | −1.4 |
| P | −999 | −0.5 | 0.3 | −1.6 | — | 0 | −0.7 | — | −1.3 |
| Q | −999 | 1.2 | 0 | −1.5 | — | 0 | 0 | — | 0.5 |
| R | −999 | 2.2 | 0.7 | −1.9 | — | −2.4 | −1.2 | — | −1 |
| S | −999 | −0.3 | 0.2 | 0.8 | — | 1 | −0.2 | — | 0.7 |
| T | −999 | 0 | 0 | 0.7 | — | 1.9 | −0.1 | — | −1.2 |
| V | −1 | 2.1 | 0.5 | −0.9 | — | 0.9 | 0.08 | — | −0.7 |
| W | 0 | −0.1 | 0 | −1.2 | — | −1 | −1.4 | — | −1 |
| Y | 0 | 0.9 | 0.8 | −1.6 | — | −1.5 | −1.2 | — | −1 |

TABLE 38

Pocket potential for HLA*0701B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −1.6 | — | −2.5 | −1.3 | — | −1.2 |
| E | −999 | 0.1 | −1.2 | −1.4 | — | −2.5 | 0.9 | — | −0.3 |
| F | 0 | 0.8 | 0.8 | 0.2 | — | −0.8 | 2.1 | — | 2.1 |
| G | −999 | 0.5 | 0.2 | −1.1 | — | −0.6 | 0 | — | −0.6 |
| H | −999 | 0.8 | 0.2 | 0.1 | — | −0.8 | 0.9 | — | −0.2 |
| I | −1 | 1.1 | 1.5 | 1.1 | — | −0.5 | 2.4 | — | 3.4 |
| K | −999 | 1.1 | 0 | −1.3 | — | −1.1 | 0.5 | — | −1.1 |
| L | −1 | 1 | 1 | −0.8 | — | −0.9 | 2.2 | — | 3.4 |
| M | −1 | 1.1 | 1.4 | −0.4 | — | −0.8 | 1.8 | — | 2 |
| N | −999 | 0.8 | 0.5 | −1.1 | — | −0.6 | 1.4 | — | −0.5 |
| P | −999 | −0.5 | 0.3 | −1.2 | — | −0.5 | −0.2 | — | −0.6 |
| Q | −999 | 1.2 | 0 | −1.5 | — | −1.1 | 1.1 | — | −0.9 |
| R | −999 | 2.2 | 0.7 | −1.1 | — | −1.1 | 0.7 | — | −0.8 |
| S | −999 | −0.3 | 0.2 | 1.5 | — | 0.6 | 0.4 | — | −0.3 |
| T | −999 | 0 | 0 | 1.4 | — | −0.1 | 0.9 | — | 0.4 |
| V | −1 | 2.1 | 0.5 | 0.9 | — | 0.1 | 1.6 | — | 2 |
| W | 0 | −0.1 | 0 | −1.1 | — | −0.9 | 1.4 | — | 0.8 |
| Y | 0 | 0.9 | 0.8 | −0.9 | — | −1 | 1.7 | — | 1.1 |

TABLE 39

Pocket potential for HLA*1501B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −0.4 | — | −0.4 | −0.7 | — | −1.9 |
| E | −999 | 0.1 | −1.2 | −0.6 | — | −1 | −0.7 | — | −1.9 |
| F | −1 | 0.8 | 0.8 | 2.4 | — | −0.3 | 1.4 | — | −0.4 |
| G | −999 | 0.5 | 0.2 | 0 | — | 0.5 | 0 | — | −0.8 |
| H | −999 | 0.8 | 0.2 | 1.1 | — | −0.5 | 0.6 | — | −1.1 |
| I | 0 | 1.1 | 1.5 | 0.6 | — | 0.05 | 1.5 | — | 0.7 |
| K | −999 | 1.1 | 0 | −0.7 | — | −0.3 | −0.3 | — | −1.7 |
| L | 0 | 1 | 1 | 0.5 | — | 0.2 | 1.9 | — | 0.5 |
| M | 0 | 1.1 | 1.4 | 1 | — | 0.1 | 1.7 | — | 0.08 |
| N | −999 | 0.8 | 0.5 | −0.2 | — | 0.7 | 0.7 | — | −1.2 |
| P | −999 | −0.5 | 0.3 | −0.3 | — | −0.2 | 0.3 | — | −1.1 |
| Q | −999 | 1.2 | 0 | −0.8 | — | −0.8 | −0.3 | — | −1.6 |
| R | −999 | 2.2 | 0.7 | 0.2 | — | 1 | −0.5 | — | −1 |
| S | −999 | −0.3 | 0.2 | −0.3 | — | 0.6 | 0.3 | — | −0.3 |

TABLE 39-continued

Pocket potential for HLA*1501B allele.

| Amino acid | P1 | P2 | P3 | P4 | P5 | P6 | P7 | P8 | P9 |
|---|---|---|---|---|---|---|---|---|---|
| T | −999 | 0 | 0 | −0.3 | — | −0 | 0.2 | — | −0.2 |
| V | 0 | 2.1 | 0.5 | 0.2 | — | −0.3 | 0.3 | — | 0.3 |
| W | −1 | −0.1 | 0 | 0.4 | — | −0.4 | 0.6 | — | −1.4 |
| Y | −1 | 0.9 | 0.8 | 2.5 | — | 0.4 | 0.7 | — | −0.9 |

TABLE 40

Exemplary Biological Activity, Exemplary Assays and Preferred Indications

| Biologically Active Protein | Biological Activity | Exemplary Activity Assay | Preferred Indication: |
|---|---|---|---|
| Factor IX (Coagulation factor IX (human); Factor IX Complex; Christmas factor; plasma thromboplastin component (PTC); prothrombin complex concentrate (PCC); Nonacog alpha; MONONINE; ALPHANINE-SD; BEBULIN; PROPLEX-T; KONYNE; PROFILNINE SD; BeneFIX; IMMUNINE VH) | Coagulation factor IX is a vitamin K-dependent factor that circulates in the blood as an inactive zymogen. Factor IX is converted to an active form by factor XIa, which excises the activation peptide and thus generates a heavy chain and a light chain held together by one or more disulfide bonds. In the blood coagulation cascade, activated factor IX activates factor X to its active form through interactions with Ca+2 ions, membrane phospholipids, and factor VIII. Alterations of this gene, including point mutations, insertions and deletions, cause factor IX deficiency, which is a recessive X-linked disorder, also called hemophilia B or Christmas disease. | Factor IX clotting activity: Valder R. et al., 2001 "Posttranslational modifications of recombinant myotube-synthesized human factor IX" Blood 97: 130-138. Activated partial thromboplastin time: Rao L V, Activation of human factor VII during clotting in vitro Blood. 1985; 65(1): 218-26; Park C H, A diagnostic challenge: mild hemophilia B with normal activated partial thromboplastin time. Blood Coagul Fibrinolysis. 2010 June; 21(4): 368-71. | Hemophilia B; bleeding; Factor IX deficiency; Christmas disease; bleeding episodes in patients with factor VIII inhibitor or Factor VII deficiency |
| Factor VII (Coagulation Factor VII; Active-site inactivated factor VII (DEGR-VIIa/FFR-VIIa); Eptacog alfa; Coagulation Factor VIIa; Novoseven; NiaStase; Novostase; MONOCLATE-P) | Coagulation factor VII is a vitamin K-dependent factor essential for hemostasis. This factor circulates in the blood in a zymogen form, and is converted to an active form by either factor IXa, factor Xa, factor XIIa, or thrombin by minor proteolysis. Upon activation of the factor VII, a heavy chain containing a catalytic domain and a light chain containing 2 EGF-like domains are generated, and two chains are held together by a disulfide bond. In the presence of factor III and calcium ions, the activated factor then further activates the coagulation cascade by converting factor IX to factor IXa and/or factor X to factor Xa. Defects in this gene can cause coagulopathy. | Coagulation Assay using Prothrombin Clotting Time (Belaaouaj A A et al., J. Biol. Chem. 275: 27123-8, 2000; Diaz-Collier J A et al., Thromb Haemost 71: 339-46, 1994). | Bleeding Disorders; Coronary Restenosis; Hemophilia A and B; Liver Disorders; Thrombosis; Vascular Restenosis; Surgery-related hemorrhagic episodes |

TABLE 41

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| FVII-AE288 | ANAFLEELRPGSLE RECKEEQCSFEEA | 674 | GCCAACGCGTTCCTGGAGGAGC TACGGCCGGGCTCCCTGGAGAG | 675 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG GTSESATPESGPGS EPATSGSETPGTSE SATPESGPGSEPAT SGSETPGTSESATP ESGPGTSTEPSEGS APGSPAGSPTSTEE GTSESATPESGPGS EPATSGSETPGTSE SATPESGPGSPAGS PTSTEEGSPAGSPT STEEGTSTEPSEGS APGTSESATPESGP GTSESATPESGPGT SESATPESGPGSEP ATSGSETPGSEPAT SGSETPGSPAGSPT STEEGTSTEPSEGS APGTSTEPSEGSAP GSEPATSGSETPGT SESATPESGPGTST EPSEGSAP | | GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACCAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCATTTCCCGGTGGTACC TCTGAAAGCGCAACTCCTGAGT CTGGCCCAGGTAGCGAACCTGC TACCTCCGGCTCTGAGACTCCA GGTACCTCTGAAAGCGCAACCC CGGAATCTGGTCCAGGTAGCGA ACCTGCAACCTCTGGCTCTGAA ACCCCAGGTACCTCTGAAAGCG CTACTCCTGAATCTGGCCCAGG TACTTCTACTGAACCGTCCGAG GGCAGCGCACCAGGTAGCCCTG CTGGCTCTCCAACCTCCACCGA AGAAGGTACCTCTGAAAGCGCA ACCCCTGAATCCGGCCCAGGTA GCGAACCGGCAACCTCCGGTTC TGAAACCCCAGGTACTTCTGAA AGCGCTACTCCTGAGTCCGCC CAGGTAGCCCGGCTGGCTCTCC GACTTCCACCGAGGAAGGTAGC CCGGCTGGCTCTCCAACTTCTA CTGAAGAAGGTACTTCTACCGA ACCTTCCGAGGGCAGCGCACCA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | GGTACTTCTGAAAGCGCTACCC CTGAGTCCGGCCCAGGTACTTC TGAAAGCGCTACTCCTGAATCC GGTCCAGGTACTTCTGAAAGCG CTACCCCGGAATCTGGCCCAGG TAGCGAACCGGCTACTTCTGGT TCTGAAACCCCAGGTAGCGAAC CGGCTACCTCCGGTTCTGAAAC TCCAGGTAGCCCAGCAGGCTCT CCGACTTCCACTGAGGAAGGTA CTTCTACTGAACCTTCCGAAGG CAGCGCACCAGGTACCTCTACT GAACCTTCTGAGGGCAGCGCTC CAGGTAGCGAACCTGCAACCTC TGGCTCTGAAACCCCAGGTACC TCTGAAAGCGCTACTCCTGAAT CTGGCCCAGGTACTTCTACTGA ACCGTCCGAGGGCAGCGCACCA | |
| FVII-AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG GSPAGSPTSTEEGT SESATPESGPGTST EPSEGSAPGSPAGS PTSTEEGTSTEPSE GSAPGTSTEPSEGS APGTSESATPESGP GSEPATSGSETPGS EPATSGSETPGSPA GSPTSTEEGTSESA TPESGPGTSTEPSE GSAPGTSTEPSEGS APGSPAGSPTSTEE GTSTEPSEGSAPGT STEPSEGSAPGTSE SATPESGPGTSTEP SEGSAPGTSESATP ESGPGSEPATSGSE TPGTSTEPSEGSAP GTSTEPSEGSAPGT SESATPESGPGTSE SATPESGPGSPAGS PTSTEEGTSESATP ESGPGSEPATSGSE TPGTSESATPESGP GTSTEPSEGSAPGT | 676 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGTGGTAGC | 677 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | STEPSEGSAPGTST | | CCGGCTGGCTCTCCTACCTCTAC | |
| | EPSEGSAPGTSTEP | | TGAGGAAGGTACTTCTGAAAGC | |
| | SEGSAPGTSTEPSE | | GCTACTCCTGAGTCTGGTCCAG | |
| | GSAPGTSTEPSEGS | | GTACCTCTACTGAACCGTCCGA | |
| | APGSPAGSPTSTEE | | AGGTAGCGCTCCAGGTAGCCCA | |
| | GTSTEPSEGSAPGT | | GCAGGCTCTCCGACTTCCACTG | |
| | SESATPESGPGSEP | | AGGAAGGTACTTCTACTGAACC | |
| | ATSGSETPGTSESA | | TTCCGAAGGCAGCGCACCAGGT | |
| | TPESGPGSEPATSG | | ACCTCTACTGAACCTTCTGAGG | |
| | SETPGTSESATPES | | GCAGCGCTCCAGGTACTTCTGA | |
| | GPGTSTEPSEGSAP | | AAGCGCTACCCCGGAATCTGGC | |
| | GTSESATPESGPGS | | CCAGGTAGCGAACCGGCTACTT | |
| | PAGSPTSTEEGSPA | | CTGGTTCTGAAACCCCAGGTAG | |
| | GSPTSTEEGSPAGS | | CGAACCGGCTACCTCCGGTTCT | |
| | PTSTEEGTSESATP | | GAAACTCCAGGTAGCCCGGCAG | |
| | ESGPGTSTEPSEGS | | GCTCTCCGACCTCTACTGAGGA | |
| | APGTSESATPESGP | | AGGTACTTCTGAAAGCGCAACC | |
| | GSEPATSGSETPGT | | CCGGAGTCCGGCCCAGGTACCT | |
| | SESATPESGPGSEP | | CTACCGAACCGTCTGAGGGCAG | |
| | ATSGSETPGTSESA | | CGCACCAGGTACTTCTACCGAA | |
| | TPESGPGTSTEPSE | | CCGTCCGAGGGTAGCGCACCAG | |
| | GSAPGSPAGSPTST | | GTAGCCCAGCAGGTTCTCCTAC | |
| | EEGTSESATPESGP | | CTCCACCGAGGAAGGTACTTCT | |
| | GSEPATSGSETPGT | | ACCGAACCGTCCGAGGGTAGCG | |
| | SESATPESGPGSPA | | CACCAGGTACCTCTACTGAACC | |
| | GSPTSTEEGSPAGS | | TTCTGAGGGCAGCGCTCCAGGT | |
| | PTSTEEGTSTEPSE | | ACTTCTGAAAGCGCTACCCCGG | |
| | GSAPGTSESATPES | | AGTCCGGTCCAGGTACTTCTAC | |
| | GPGTSESATPESGP | | TGAACCGTCCGAAGGTAGCGCA | |
| | GTSESATPESGPGS | | CCAGGTACTTCTGAAAGCGCAA | |
| | EPATSGSETPGSEP | | CCCCTGAATCCGGTCCAGGTAG | |
| | ATSGSETPGSPAGS | | CGAACCGGCTACTTCTGGCTCT | |
| | PTSTEEGTSTEPSE | | GAGACTCCAGGTACTTCTACCG | |
| | GSAPGTSTEPSEGS | | AACCGTCCGAAGGTAGCGCACC | |
| | APGSEPATSGSETP | | AGGTACTTCTACTGAACCGTCT | |
| | GTSESATPESGPGT | | GAAGGTAGCGCACCAGGTACTT | |
| | STEPSEGSAP | | CTGAAAGCGCAACCCCGGAATC | |
| | | | CGGCCCAGGTACCTCTGAAAGC | |
| | | | GCAACCCCGGAGTCCGGCCCAG | |
| | | | GTAGCCCTGCTGGCTCTCCAAC | |
| | | | CTCCACCGAAGAAGGTACCTCT | |
| | | | GAAAGCGCAACCCCTGAATCCG | |
| | | | GCCCAGGTAGCGAACCGGCAAC | |
| | | | CTCCGGTTCTGAAACCCCAGGT | |
| | | | ACCTCTGAAAGCGCTACTCCGG | |
| | | | AGTCTGGCCCAGGTACCTCTAC | |
| | | | TGAACCGTCTGAGGGTAGCGCT | |
| | | | CCAGGTACTTCTACTGAACCGT | |
| | | | CCGAAGGTAGCGCACCAGGTAC | |
| | | | TTCTACCGAACCGTCCGAAGGC | |
| | | | AGCGCTCCAGGTACCTCTACTG | |
| | | | AACCTTCCGAGGGCAGCGCTCC | |
| | | | AGGTACCTCTACCGAACCTTCT | |
| | | | GAAGGTAGCGCACCAGGTACTT | |
| | | | CTACCGAACCGTCCGAGGGTAG | |
| | | | CGCACCAGGTAGCCCAGCAGGT | |
| | | | TCTCCTACCTCCACCGAGGAAG | |
| | | | GTACTTCTACCGAACCGTCCGA | |
| | | | GGGTAGCGCACCAGGTACCTCT | |
| | | | GAAAGCGCAACTCCTGAGTCTG | |
| | | | GCCCAGGTAGCGAACCTGCTAC | |
| | | | CTCCGGCTCTGAGACTCCAGGT | |
| | | | ACCTCTGAAAGCGCAACCCCGG | |
| | | | AATCTGGTCCAGGTAGCGAACC | |
| | | | TGCAACCTCTGGCTCTGAAACC | |
| | | | CCAGGTACCTCTGAAAGCGCTA | |
| | | | CTCCTGAATCGGCCCAGGTAC | |
| | | | TTCTACTGAACCGTCCGAGGGC | |
| | | | AGCGCACCAGGTACTTCTGAAA | |
| | | | GCGCTACTCCTGAGTCCGGCCC | |
| | | | AGGTAGCCCGGCTGGCTCTCCG | |
| | | | ACTTCCACCGAGGAAGGTAGCC | |
| | | | CGGCTGGCTCTCCAACTTCTACT | |
| | | | GAAGAAGGTAGCCCGGCAGGC | |
| | | | TCTCCGACCTCTACTGAGGAAG | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | GTACTTCTGAAAGCGCAACCCC GGAGTCCGGCCCAGGTACCTCT ACCGAACCGTCTGAGGGCAGCG CACCAGGTACCTCTGAAAGCGC AACTCCTGAGTCTGGCCCAGGT AGCGAACCTGCTACCTCCGGCT CTGAGACTCCAGGTACCTCTGA AAGCGCAACCCCGGAATCTGGT CCAGGTAGCGAACCTGCAACCT CTGGCTCTGAAACCCCAGGTAC CTCTGAAAGCGCTACTCCTGAA TCTGGCCCAGGTACTTCTACTG AACCGTCCGAGGGCAGCGCACC AGGTAGCCCTGCTGGCTCTCCA ACCTCCACCGAAGAAGGTACCT CTGAAAGCGCAACCCCTGAATC CGGCCCAGGTAGCGAACCGGCA ACCTCCGGTTCTGAAACCCCAG GTACTTCTGAAAGCGCTACTCC TGAGTCCGGCCCAGGTAGCCCG GCTGGCTCTCCGACTTCCACCG AGGAAGGTAGCCCGGCTGGCTC TCCAACTTCTACTGAAGAAGGT ACTTCTACCGAACCTTCCGAGG GCAGCGCACCAGGTACTTCTGA AAGCGCTACCCCTGAGTCCGGC CCAGGTACTTCTGAAAGCGCTA CTCCTGAATCCGGTCCAGGTAC TTCTGAAAGCGCTACCCCGGAA TCTGGCCCAGGTAGCGAACCGG CTACTTCTGGTTCTGAAACCCC AGGTAGCGAACCGGCTACCTCC GGTTCTGAAACTCCAGGTAGCC CAGCAGGCTCTCCGACTTCCAC TGAGGAAGGTACTTCTACTGAA CCTTCCGAAGGCAGCGCACCAG GTACCTCTACTGAACCTTCTGA GGGCAGCGCTCCAGGTAGCGAA CCTGCAACCTCTGGCTCTGAAA CCCCAGGTACCTCTGAAAGCGC TACTCCTGAATCTGGCCCAGGT ACTTCTACTGAACCGTCCGAGG GCAGCGCACCA | |
| FVII-AF864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG | 678 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGCAAGGTGTGCCCCAAA GGGGAGTGTCCATGGCAGGTCC TGTTGTTGGTGAATGGAGCTCA GTTGTGTGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC | 679 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | GSTSESPSGTAPGT | | AGGTCATCATCCCCAGCACGTA | |
| | SPSGESSTAPGSTS | | CGTCCCGGGCACCACCAACCAC | |
| | ESPSGTAPGSTSES | | GACATCGCGCTGCTCCGCCTGC | |
| | PSGTAPGTSTPESG | | ACCAGCCCGTGGTCCTCACTGA | |
| | SASPGTSTPESGSA | | CCATGTGGTGCCCCTCTGCCTG | |
| | SPGSTSESPSGTAP | | CCCGAACGGACGTTCTCTGAGA | |
| | GSTSESPSGTAPGT | | GGACGCTGGCCTTCGTGCGCTT | |
| | SPSGESSTAPGSTS | | CTCATTGGTCAGCGGCTGGGGC | |
| | ESPSGTAPGTSPSG | | CAGCTGCTGGACCGTGGCGCCA | |
| | ESSTAPGTSPSGES | | CGGCCCTGGAGCTCATGGTCCT | |
| | STAPGSTSSTAESP | | CAACGTGCCCCGGCTGATGACC | |
| | GPGTSPSGESSTAP | | CAGGACTGCCTGCAGCAGTCAC | |
| | GTSPSGESSTAPGS | | GGAAGGTGGGAGACTCCCCAA | |
| | TSSTAESPGPGTST | | ATATCACGGAGTACATGTTCTG | |
| | PESGSASPGTSTPE | | TGCCGGCTACTCGGATGGCAGC | |
| | SGSASPGSTSESPS | | AAGGACTCCTGCAAGGGGGAC | |
| | GTAPGSTSESPSGT | | AGTGGAGGCCCACATGCCACCC | |
| | APGTSTPESGSASP | | ACTACCGGGGCACGTGGTACCT | |
| | GSTSSTAESPGPGT | | GACGGGCATCGTCAGCTGGGGC | |
| | STPESGSASPGSTS | | CAGGGCTGCGCAACCGTGGGCC | |
| | ESPSGTAPGTSPSG | | ACTTTGGGGTGTACACCAGGGT | |
| | ESSTAPGSTSSTAE | | CTCCCAGTACATCGAGTGGCTG | |
| | SPGPGTSPSGESST | | CAAAAGCTCATGCGCTCAGAGC | |
| | APGTSTPESGSASP | | CACGCCCAGGAGTCCTCCTGCG | |
| | GSTSSTAESPGPGS | | AGCCCCATTTCCCGGTGGTTCT | |
| | TSSTAESPGPGSTS | | ACCAGCGAATCTCCTTCTGGCA | |
| | STAESPGPGSTSST | | CCGCTCCAGGTACCTCTCCTAG | |
| | AESPGPGTSPSGES | | CGGCGAATCTTCTACCGCTCCA | |
| | STAPGSTSESPSGT | | GGTTCTACTAGCGAATCTCCTTC | |
| | APGSTSESPSGTAP | | TGGCACTGCACCAGGTTCTACT | |
| | GTSTPESGPXXXG | | AGCGAATCCCCGTCTGGTACTG | |
| | ASASGAPSTXXXX | | CTCCAGGTACTTCTACTCCTGA | |
| | SESPSGTAPGSTSE | | AAGCGGTTCCGCTTCTCCAGGT | |
| | SPSGTAPGSTSESP | | ACCTCTACTCCGGAAAGCGGTT | |
| | SGTAPGSTSESPSG | | CTGCATCTCCAGGTTCTACCAG | |
| | TAPGSTSESPSGTA | | CGAATCTCCTTCTGGCACCGCT | |
| | PGSTSESPSGTAPG | | CCAGGTTCTACTAGCGAATCCC | |
| | TSTPESGSASPGTS | | CGTCTGGTACCGCACCAGGTAC | |
| | PSGESSTAPGTSPS | | TTCTCCTAGCGGCGAATCTTCTA | |
| | GESSTAPGSTSSTA | | CCGCACCAGGTTCTACTAGCGA | |
| | ESPGPGTSPSGESS | | ATCTCCGTCTGGCACTGCTCCA | |
| | TAPGTSTPESGSAS | | GGTACTTCTCCTAGCGGTGAAT | |
| | PGSTSESPSGTAPG | | CTTCTACCGCTCCAGGTACTTCC | |
| | STSESPSGTAPGTS | | CCTAGCGGCGAATCTTCTACCG | |
| | PSGESSTAPGSTSE | | CTCCAGGTTCTACTAGCTCTACT | |
| | SPSGTAPGTSTPES | | GCAGAATCTCCGGGCCCAGGTA | |
| | GSASPGTSTPESGS | | CCTCTCCTAGCGGTGAATCTTCT | |
| | ASPGSTSESPSGTA | | ACCGCTCCAGGTACTTCTCCGA | |
| | PGTSTPESGSASPG | | GCGGTGAATCTTCTACCGCTCC | |
| | STSSTAESPGPGST | | AGGTTCTACTAGCTCTACTGCA | |
| | SESPSGTAPGSTSE | | GAATCTCCTGGCCCAGGTACCT | |
| | SPSGTAPGTSPSGE | | CTACTCCGGAAAGCGGCTCTGC | |
| | SSTAPGSTSSTAES | | ATCTCCAGGTACTTCTACCCCTG | |
| | PGPGTSPSGESSTA | | AAAGCGGTTCTGCATCTCCAGG | |
| | PGTSTPESGSASPG | | TTCTACTAGCGAATCTCCTTCTG | |
| | TSPSGESSTAPGTS | | GCACTGCACCAGGTTCTACCAG | |
| | PSGESSTAPGTSPS | | CGAATCTCCGTCTGGCACTGCA | |
| | GESSTAPGSTSSTA | | CCAGGTACCTCTACCCCTGAAA | |
| | ESPGPGTSSTAES | | GCGGTTCCGCTTCTCCAGGTTCT | |
| | PGPGTSPSGESSTA | | ACCAGCTCTACCGCAGAATCTC | |
| | PGSSPSASTGTGPG | | CTGGTCCAGGTACCTCTACTCC | |
| | SSTPSGATGSPGSS | | GGAAAGCGGCTCTGCATCTCCA | |
| | TPSGATGSP | | GGTTCTACTAGCGAATCTCCTTC | |
| | | | TGGCACTGCACCAGGTACTTCT | |
| | | | CCGAGCGGTGAATCTTCTACCG | |
| | | | CACCAGGTTCTACTAGCTCTAC | |
| | | | CGCTGAATCTCCGGGCCCAGGT | |
| | | | ACTTCTCCGAGCGGTGAATCTT | |
| | | | CTACTGCTCCAGGTACCTCTACT | |
| | | | CCTGAAAGCGGTTCTGCATCTC | |
| | | | CAGGTTCCACTAGCTCTACCGC | |
| | | | AGAATCTCCGGGCCCAGGTTCT | |
| | | | ACTAGCTCTACTGCTGAATCTC | |
| | | | CTGGCCCAGGTTCTACTAGCTC | |
| | | | TACTGCTGAATCTCCGGGTCCA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | GGTTCTACCAGCTCTACTGCTG AATCTCCTGGTCCAGGTACCTC CCCGAGCGGTGAATCTTCTACT GCACCAGGTTCTACTAGCGAAT CTCCTTCTGGCACTGCACCAGG TTCTACCAGCGAATCTCCGTCT GGCACTGCACCAGGTACCTCTA CCCCTGAAAGCGGTCCXXXXXX XXXXXXTGCAAGCGCAAGCGG CGCGCCAAGCACGGGAXXXXX XXXTAGCGAATCTCCTTCTGGT ACCGCTCCAGGTTCTACCAGCG AATCCCCGTCTGGTACTGCTCC AGGTTCTACCAGCGAATCTCCT TCTGGTACTGCACCAGGTTCTA CTAGCGAATCTCCTTCTGGTAC CGCTCCAGGTTCTACCAGCGAA TCCCCGTCTGGTACTGCTCCAG GTTCTACCAGCGAATCTCCTTCT GGTACTGCACCAGGTACTTCTA CTCCGGAAAGCGGTTCCGCATC TCCAGGTACTTCTCCTAGCGGT GAATCTTCTACTGCTCCAGGTA CCTCTCCTAGCGGCGAATCTTCT ACTGCTCCAGGTTCTACCAGCT CTACTGCTGAATCTCCGGGTCC AGGTACTTCCCCGAGCGGTGAA TCTTCTACTGCACCAGGTACTTC TACTCCGGAAAGCGGTTCCGCT TCTCCAGGTTCTACCAGCGAAT CTCCTTCTGGCACCGCTCCAGG TTCTACTAGCGAATCCCCGTCT GGTACCGCACCAGGTACTTCTC CTAGCGGCGAATCTTCTACCGC ACCAGGTTCTACTAGCGAATCC CCGTCTGGTACCGCACCAGGTA CTTCTACCCCGGAAAGCGGCTC TGCTTCTCCAGGTACTTCTACCC CGGAAAGCGGCTCCGCATCTCC AGGTTCTACTAGCGAATCTCCT TCTGGTACCGCTCCAGGTACTT CTACCCCTGAAAGCGGCTCCGC TTCTCCAGGTTCCACTAGCTCTA CCGCTGAATCTCCGGGTCCAGG TTCTACCAGCGAATCTCCTTCTG GCACCGCTCCAGGTTCTACTAG CGAATCCCCGTCTGGTACCGCA CCAGGTACTTCTCCTAGCGGCG AATCTTCTACCGCACCAGGTTC TACCAGCTCTACTGCTGAATCT CCGGGTCCAGGTACTTCCCCGA GCGGTGAATCTTCTACTGCACC AGGTACTTCTACTCCGGAAAGC GGTTCCGCTTCTCCAGGTACCTC CCCTAGCGGCGAATCTTCTACT GCTCCAGGTACCTCTCCTAGCG GCGAATCTTCTACCGCTCCAGG TACCTCCCCTAGCGGTGAATCT TCTACCGCACCAGGTTCTACTA GCTCTACTGCTGAATCTCCGGG TCCAGGTTCTACCAGCTCTACT GCTGAATCTCCTGGTCCAGGTA CCTCCCCGAGCGGTGAATCTTC TACTGCACCAGGTTCTAGCCCT TCTGCTTCCACCGGTACCGGCC CAGGTAGCTCTACTCCGTCTGG TGCAACTGGCTCTCCAGGTAGC TCTACTCCGTCTGGTGCAACCG GCTCCCCA | |
| FVII-AG864 | ANAFLEELRPGSLE RECKEEQCSFEEA REIFKDAERTKLF WISYSDGDQCASS PCQNGGSCKDQLQ | 680 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA | 681 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | SYICFCLPAFEGRN | | CGAAGCTGTTCTGGATTTCTTAC | |
| | CETHKDDQLICVN | | AGTGATGGGGACCAGTGTGCCT | |
| | ENGGCEQYCSDHT | | CAAGTCCATGCCAGAATGGGGG | |
| | GTKRSCRCHEGYS | | CTCCTGCAAGGACCAGCTCCAG | |
| | LLADGVSCTPTVE | | TCCTATATCTGCTTCTGCCTCCC | |
| | YPCGKIPILEKRNA | | TGCCTTCGAGGGCCGGAACTGT | |
| | SKPQGRIVGGKVC | | GAGACGCACAAGGATGACCAG | |
| | PKGECPWQVLLLV | | CTGATCTGTGTGAACGAGAACG | |
| | NGAQLCGGTLINTI | | GCGGCTGTGAGCAGTACTGCAG | |
| | WVVSAAHCFDKIK | | TGACCACACGGGCACCAAGCGC | |
| | NWRNLIAVLGEHD | | TCCTGTCGGTGCCACGAGGGGT | |
| | LSEHDGDEQSRRV | | ACTCTCTGCTGGCAGCGGGGT | |
| | AQVIIPSTYVPGTT | | GTCCTGCACACCCACAGTTGAA | |
| | NHDIALLRLHQPV | | TATCCATGTGGAAAAATACCTA | |
| | VLTDHVVPLCLPE | | TTCTAGAAAAAGAAATGCCAG | |
| | RTFSERTLAFVRFS | | CAAACCCCAAGGCCGAATTGTG | |
| | LVSGWGQLLDRG | | GGGGGCAAGGTGTGCCCCAAA | |
| | ATALELMVLNVPR | | GGGGAGTGTCCATGGCAGGTCC | |
| | LMTQDCLQQSRK | | TGTTGTTGGTGAATGGAGCTCA | |
| | VGDSPNITEYMFC | | GTTGTGTGGGGGACCCTGATC | |
| | AGYSDGSKDSCKG | | AACACCATCTGGGTGGTCTCCG | |
| | DSGGPHATHYRGT | | CGGCCCACTGTTTCGACAAAAT | |
| | WYLTGIVSWGQG | | CAAGAACTGGAGGAACCTGATC | |
| | CATVGHFGVYTRV | | GCGGTGCTGGGCGAGCACGACC | |
| | SQYIEWLQKLMRS | | TCAGCGAGCACGACGGGGATG | |
| | EPRPGVLLRAPFPG | | AGCAGAGCCGGCGGGTGGCGC | |
| | GASPGTSSTGSPGS | | AGGTCATCATCCCCAGCACGTA | |
| | SPSASTGTGPGSSP | | CGTCCCGGGCACCACCAACCAC | |
| | SASTGTGPGTPGS | | GACATCGCGCTGCTCCGCCTGC | |
| | GTASSSPGSSTPSG | | ACCAGCCCGTGGTCCTCACTGA | |
| | ATGSPGSNPSASTG | | CCATGTGGTGCCCCTCTGCCTG | |
| | TGPGASPGTSSTGS | | CCCGAACGGACGTTCTCTGAGA | |
| | PGTPGSGTASSSPG | | GGACGCTGGCCTTCGTGCGCTT | |
| | SSTPSGATGSPGTP | | CTCATTGGTCAGCGGCTGGGGC | |
| | GSGTASSSPGASPG | | CAGCTGCTGGACCGTGGCGCCA | |
| | TSSTGSPGASPGTS | | CGGCCCTGGAGCTCATGGTCCT | |
| | STGSPGTPGSGTAS | | CAACGTGCCCCGGCTGATGACC | |
| | SSPGSSTPSGATGS | | CAGGACTGCCTGCAGCAGTCAC | |
| | PGASPGTSSTGSPG | | GGAAGGTGGGAGACTCCCAA | |
| | TPGSGTASSSPGSS | | ATATCACGGAGTACATGTTCTG | |
| | TPSGATGSPGSNPS | | TGCCGGCTACTCGGATGGCAGC | |
| | ASTGTGPGSSPSAS | | AAGGACTCCTGCAAGGGGGAC | |
| | TGTGPGSSTPSGAT | | AGTGGAGGCCCACATGCCACCC | |
| | GSPGSSTPSGATGS | | ACTACCGGGGCACGTGGTACCT | |
| | PGASPGTSSTGSPG | | GACGGGCATCGTCAGCTGGGGC | |
| | ASPGTSSTGSPGAS | | CAGGGCTGCGCAACCGTGGGCC | |
| | PGTSSTGSPGTPGS | | ACTTTGGGGTGTACACCAGGGT | |
| | GTASSSPGASPGTS | | CTCCCAGTACATCGAGTGGCTG | |
| | STGSPGASPGTSST | | CAAAAGCTCATGCGCTCAGAGC | |
| | GSPGASPGTSSTGS | | CACGCCCAGGAGTCCTCCTGCG | |
| | PGSSPSASTGTGPG | | AGCCCCATTTCCCGGTGGTGCT | |
| | TPGSGTASSSPGAS | | TCCCCGGGCACCAGCTCTACTG | |
| | PGTSSTGSPGASPG | | GTTCTCCAGGTTCTAGCCCGTCT | |
| | TSSTGSPGASPGTS | | GCTTCTACTGGTACTGGTCCAG | |
| | STGSPGSSTPSGAT | | GTTCTAGCCCTTCTGCTTCCACT | |
| | GSPGSSTPSGATGS | | GGTACTGGTCCAGGTACCCCGG | |
| | PGASPGTSSTGSPG | | GTAGCGGTACCGCTTCTTCTTCT | |
| | TPGSGTASSSPGSS | | CCAGGTAGCTCTACTCCGTCTG | |
| | TPSGATGSPGSSTP | | GTGCTACCGGCTCTCCAGGTTC | |
| | SGATGSPGSSTPSG | | TAACCCTTCTGCATCCACCGGT | |
| | ATGSPGSSPSASTG | | ACCGGCCCAGGTGCTTCTCCGG | |
| | TGPGASPGTSSTGS | | GCACCAGCTCTACTGGTTCTCC | |
| | PGASPGTSSTGSPG | | AGGTACCCGGGCAGCGGTACC | |
| | TPGSGTASSSPGAS | | GCATCTTCTTCTCCAGGTAGCTC | |
| | PGTSSTGSPGASPG | | TACTCCTTCTGGTGCAACTGGTT | |
| | TSSTGSPGASPGTS | | CTCCAGGTACTCCTGGCAGCGG | |
| | STGSPGASPGTSST | | TACCGCTTCTTCTTCTCCAGGTG | |
| | GSPGTPGSGTASSS | | CTTCTCCTGGTACTAGCTCTACT | |
| | PGSSTPSGATGSPG | | GGTTCTCCAGGTGCTTCTCCGG | |
| | TPGSGTASSSPGSS | | GCACTAGCTCTACTGGTTCTCC | |
| | TPSGATGSPGTPGS | | AGGTACCCGGGTAGCGGTACT | |
| | GTASSPGSSTPSG | | GCTTCTTCCTCTCCAGGTAGCTC | |
| | ATGSPGSSTPSGAT | | TACCCCTTCTGGTGCAACCGGC | |
| | GSPGSSPSASTGTG | | TCTCCAGGTGCTTCTCCGGGCA | |
| | PGSSPSASTGTGPG | | CCAGCTCTACCGGTTCTCCAGG | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | ASPGTSSTGSPGTP | | TACCCCGGGTAGCGGTACCGCT | |
| | GSGTASSSPGSSTP | | TCTTCTTCTCCAGGTAGCTCTAC | |
| | SGATGSPGSSPSAS | | TCCGTCTGGTGCTACCGGCTCTC | |
| | TGTGPGSSPSASTG | | CAGGTTCTAACCCTTCTGCATCC | |
| | TGPGASPGTSSTGS | | ACCGGTACCGGCCCAGGTTCTA | |
| | PGASPGTSSTGSPG | | GCCCTTCTGCTTCCACCGGTACT | |
| | SSTPSGATGSPGSS | | GGCCCAGGTAGCTCTACCCCTT | |
| | PSASTGTGPGASPG | | CTGGTGCTACCGGCTCCCCAGG | |
| | TSSTGSPGSSPSAS | | TAGCTCTACTCCTTCTGGTGCAA | |
| | TGTGPGTPGSGTA | | CTGGCTCTCCAGGTGCATCTCC | |
| | SSSPGSSTPSGATG | | GGGCACTAGCTCTACTGGTTCT | |
| | SPGSSTPSGATGSP | | CCAGGTGCATCCCCTGGCACTA | |
| | GASPGTSSTGSP | | GCTCTACTGGTTCTCCAGGTGCT | |
| | | | TCTCCTGGTACCAGCTCTACTG | |
| | | | GTTCTCCAGGTACTCCTGGCAG | |
| | | | CGGTACCGCTTCTTCTTCTCCAG | |
| | | | GTGCTTCTCCTGGTACTAGCTCT | |
| | | | ACTGGTTCTCCAGGTGCTTCTCC | |
| | | | GGGCACTAGCTCTACTGGTTCT | |
| | | | CCAGGTGCTTCCCCGGGCACTA | |
| | | | GCTCTACCGGTTCTCCAGGTTCT | |
| | | | AGCCCTTCTGCATCTACTGGTA | |
| | | | CTGGCCCAGGTACTCCGGGCAG | |
| | | | CGGTACTGCTTCTTCCTCTCCAG | |
| | | | GTGCATCTCCGGGCACTAGCTC | |
| | | | TACTGGTTCTCCAGGTGCATCC | |
| | | | CCTGGCACTAGCTCTACTGGTT | |
| | | | CTCCAGGTGCTTCTCCTGGTACC | |
| | | | AGCTCTACTGGTTCTCCAGGTA | |
| | | | GCTCTACTCCGTCTGGTGCAAC | |
| | | | CGGTTCCCCAGGTAGCTCTACT | |
| | | | CCTTCTGGTGCTACTGGCTCCCC | |
| | | | AGGTGCATCCCCTGGCACCAGC | |
| | | | TCTACCGGTTCTCCAGGTACCC | |
| | | | CGGGCAGCGGTACCGCATCTTC | |
| | | | CTCTCCAGGTAGCTCTACCCCG | |
| | | | TCTGGTGCTACCGGTTCCCCAG | |
| | | | GTAGCTCTACCCCGTCTGGTGC | |
| | | | AACCGGCTCCCCAGGTAGCTCT | |
| | | | ACTCCGTCTGGTGCAACCGGCT | |
| | | | CCCCAGGTTCTAGCCCGTCTGC | |
| | | | TTCCACTGGTACTGGCCCAGGT | |
| | | | GCTTCCCCGGGCACCAGCTCTA | |
| | | | CTGGTTCTCCAGGTGCATCCCC | |
| | | | GGGTACCAGCTCTACCGGTTCT | |
| | | | CCAGGTACTCCTGGCAGCGGTA | |
| | | | CTGCATCTTCCTCTCCAGGTGCT | |
| | | | TCTCCGGGCACCAGCTCTACTG | |
| | | | GTTCTCCAGGTGCATCTCCGGG | |
| | | | CACTAGCTCTACTGGTTCTCCA | |
| | | | GGTGCATCCCCTGGCACTAGCT | |
| | | | CTACTGGTTCTCCAGGTGCTTCT | |
| | | | CCTGGTACCAGCTCTACTGGTT | |
| | | | CTCCAGGTACCCCTGGTAGCGG | |
| | | | TACTGCTTCTTCCTCTCCAGGTA | |
| | | | GCTCTACTCCGTCTGGTGCTACC | |
| | | | GGTTCTCCAGGTACCCCGGGTA | |
| | | | GCGGTACCGCATCTTCTTCTCCA | |
| | | | GGTAGCTCTACCCCGTCTGGTG | |
| | | | CTACTGGTTCTCCAGGTACTCC | |
| | | | GGGCAGCGGTACTGCTTCTTCC | |
| | | | TCTCCAGGTAGCTCTACCCCTTC | |
| | | | TGGTGCTACTGGCTCTCCAGGT | |
| | | | AGCTCTACCCCGTCTGGTGCTA | |
| | | | CTGGCTCCCCAGGTTCTAGCCC | |
| | | | TTCTGCATCCACCGGTACCGGT | |
| | | | CCAGGTTCTAGCCCGTCTGCAT | |
| | | | CTACTGGTACTGGTCCAGGTGC | |
| | | | ATCCCCGGGCACTAGCTCTACC | |
| | | | GGTTCTCCAGGTACTCCTGGTA | |
| | | | GCGGTACTGCTTCTTCTTCTCCA | |
| | | | GGTAGCTCTACTCCTTCTGGTGC | |
| | | | TACTGGTTCTCCAGGTTCTAGCC | |
| | | | CTTCTGCATCCACCGGTACCGG | |
| | | | CCCAGGTTCTAGCCCGTCTGCTT | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | CTACCGGTACTGGTCCAGGTGC TTCTCCGGGTACTAGCTCTACTG GTTCTCCAGGTGCATCTCCTGGT ACTAGCTCTACTGGTTCTCCAG GTAGCTCTACTCCGTCTGGTGC AACCGGCTCTCCAGGTTCTAGC CCTTCTGCATCTACCGGTACTG GTCCAGGTGCATCCCCTGGTAC CAGCTCTACCGGTTCTCCAGGT TCTAGCCCTTCTGCTTCTACCGG TACCGGTCCAGGTACCCCTGGC AGCGGTACCGCATCTTCCTCTC CAGGTAGCTCTACTCCGTCTGG TGCAACCGGTTCCCCAGGTAGC TCTACTCCTTCTGGTGCTACTGG CTCCCCAGGTGCATCCCCTGGC ACCAGCTCTACCGGTTCTCCA | |
| FVII-AM875 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG GTSTEPSEGSAPGS EPATSGSETPGSPA GSPTSTEEGSTSST AESPGPGTSTPESG SASPGSTSESPSGT APGSTSESPSGTAP GTSTPESGSASPGT STPESGSASPGSEP ATSGSETPGTSESA TPESGPGSPAGSPT STEEGTSTEPSEGS APGTSESATPESGP GTSTEPSEGSAPGT STEPSEGSAPGSPA GSPTSTEEGTSTEP SEGSAPGTSTEPSE GSAPGTSESATPES GPGTSESATPESGP GTSTEPSEGSAPGT STEPSEGSAPGTSE SATPESGPGTSTEP SEGSAPGSEPATSG SETPGSPAGSPTST EEGSSTPSGATGSP GTPGSGTASSSPGS STPSGATGSPGTST | 682 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGTGGTACT TCTACTGAACCGTCTGAAGGCA | 683 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | EPSEGSAPGTSTEP | | GCGCACCAGGTAGCGAACCGGC | |
| | SEGSAPGSEPATSG | | TACTTCCGGTTCTGAAACCCCA | |
| | SETPGSPAGSPTST | | GGTAGCCCAGCAGGTTCTCCAA | |
| | EEGSPAGSPTSTEE | | CTTCTACTGAAGAAGGTTCTAC | |
| | GTSTEPSEGSAPGA | | CAGCTCTACCGCAGAATCTCCT | |
| | SASGAPSTGGTSES | | GGTCCAGGTACCTCTACTCCGG | |
| | ATPESGPGSPAGSP | | AAAGCGGCTCTGCATCTCCAGG | |
| | TSTEEGSPAGSPTS | | TTCTACTAGCGAATCTCCTTCTG | |
| | TEEGSTSSTAESPG | | GCACTGCACCAGGTTCTACTAG | |
| | PGSTSESPSGTAPG | | CGAATCCCCGTCTGGTACTGCT | |
| | TSPSGESSTAPGTP | | CCAGGTACTTCTACTCCTGAAA | |
| | GSGTASSSPGSSTP | | GCGGTTCCGCTTCTCCAGGTAC | |
| | SGATGSPGSSPSAS | | CTCTACTCCGGAAAGCGGTTCT | |
| | TGTGPGSEPATSGS | | GCATCTCCAGGTAGCGAACCGG | |
| | ETPGTSESATPESG | | CAACCTCCGGCTCTGAAACCCC | |
| | PGSEPATSGSETPG | | AGGTACCTCTGAAAGCGCTACT | |
| | STSSTAESPGPGST | | CCTGAATCCGGCCCAGGTAGCC | |
| | SSTAESPGPGTSPS | | CGGCAGGTTCTCCGACTTCCAC | |
| | GESSTAPGSEPATS | | TGAGGAAGGTACCTCTACTGAA | |
| | GSETPGSEPATSGS | | CCTTCTGAGGGCAGCGCTCCAG | |
| | ETPGTSTEPSEGSA | | GTACTTCTGAAAGCGCTACCCC | |
| | PGSTSSTAESPGPG | | GGAGTCCGGTCCAGGTACTTCT | |
| | TSTPESGSASPGST | | ACTGAACCGTCCGAAGGTAGCG | |
| | SESPSGTAPGTSTE | | CACCAGGTACTTCTACCGAACC | |
| | PSEGSAPGTSTEPS | | GTCCGAGGGTAGCGCACCAGGT | |
| | EGSAPGTSTEPSEG | | AGCCCAGCAGGTTCTCCTACCT | |
| | SAPGSSTPSGATGS | | CCACCGAGGAAGGTACTTCTAC | |
| | PGSSPSASTGTGPG | | CGAACCGTCCGAGGGTAGCGCA | |
| | ASPGTSSTGSPGSE | | CCAGGTACTTCTACCGAACCTT | |
| | PATSGSETPGTSES | | CCGAGGGCAGCGCACCAGGTAC | |
| | ATPESGPGSPAGSP | | TTCTGAAAGCGCTACCCCTGAG | |
| | TSTEEGSSTPSGAT | | TCCGGCCCAGGTACTTCTGAAA | |
| | GSPGSSPSASTGTG | | GCGCTACTCCTGAATCCGGTCC | |
| | PGASPGTSSTGSPG | | AGGTACCTCTACTGAACCTTCC | |
| | TSESATPESGPGTS | | GAAGGCAGCGCTCCAGGTACCT | |
| | TEPSEGSAPGTSTE | | CTACCGAACCGTCCGAGGGCAG | |
| | PSEGSAP | | CGCACCAGGTACTTCTGAAAGC | |
| | | | GCAACCCCTGAATCCGGTCCAG | |
| | | | GTACTTCTACTGAACCTTCCGA | |
| | | | AGGTAGCGCTCCAGGTAGCGAA | |
| | | | CCTGCTACTTCTGGTTCTGAAAC | |
| | | | CCCAGGTAGCCCGGCTGGCTCT | |
| | | | CCGACCTCCACCGAGGAAGGTA | |
| | | | GCTCTACCCCGTCTGGTGCTACT | |
| | | | GGTTCTCCAGGTACTCCGGGCA | |
| | | | GCGGTACTGCTTCTTCCTCTCCA | |
| | | | GGTAGCTCTACCCCTTCTGGTG | |
| | | | CTACTGGCTCTCCAGGTACCTCT | |
| | | | ACCGAACCGTCCGAGGGTAGCG | |
| | | | CACCAGGTACCTCTACTGAACC | |
| | | | GTCTGAGGGTAGCGCTCCAGGT | |
| | | | AGCGAACCGGCAACCTCCGGTT | |
| | | | CTGAAACTCCAGGTAGCCCTGC | |
| | | | TGGCTCTCCGACTTCTACTGAG | |
| | | | GAAGGTAGCCCGGCTGGTTCTC | |
| | | | CGACTTCTACTGAGGAAGGTAC | |
| | | | TTCTACCGAACCTTCCGAAGGT | |
| | | | AGCGCTCCAGGTGCAAGCGCAA | |
| | | | GCGGCGCGCCAAGCACGGGAG | |
| | | | GTACTTCTGAAAGCGCTACTCC | |
| | | | TGAGTCCGGCCCAGGTAGCCCG | |
| | | | GCTGGCTCTCCGACTTCCACCG | |
| | | | AGGAAGGTAGCCCGGCTGGCTC | |
| | | | TCCAACTTCTACTGAAGAAGGT | |
| | | | TCTACCAGCTCTACCGCTGAAT | |
| | | | CTCCTGGCCCAGGTTCTACTAG | |
| | | | CGAATCTCCGTCTGGCACCGCA | |
| | | | CCAGGTACTTCCCTAGCGGTG | |
| | | | AATCTTCTACTGCACCAGGTAC | |
| | | | CCTGGCAGCGGTACCGCTTCT | |
| | | | TCCTCTCCAGGTAGCTCTACCCC | |
| | | | GTCTGGTGCTACTGGCTCTCCA | |
| | | | GGTTCTAGCCCGTCTGCATCTA | |
| | | | CCGGTACCGGCCCAGGTAGCGA | |
| | | | ACCGGCAACCTCCGGCTCTGAA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | ACTCCAGGTACTTCTGAAAGCG<br>CTACTCCGGAATCCGGCCCAGG<br>TAGCGAACCGGCTACTTCCGGC<br>TCTGAAACCCAGGTTCCACCA<br>GCTCTACTGCAGAATCTCCGGG<br>CCCAGGTTCTACTAGCTCTACT<br>GCAGAATCTCCGGGTCCAGGTA<br>CTTCTCCTAGCGGCGAATCTTCT<br>ACCGCTCCAGGTAGCGAACCGG<br>CAACCTCTGGCTCTGAAACTCC<br>AGGTAGCGAACCTGCAACCTCC<br>GGCTCTGAAACCCAGGTACTT<br>CTACTGAACCTTCTGAGGGCAG<br>CGCACCAGGTTCTACCAGCTCT<br>ACCGCAGAATCTCCTGGTCCAG<br>GTACCTCTACTCCGGAAAGCGG<br>CTCTGCATCTCCAGGTTCTACTA<br>GCGAATCTCCTTCTGGCACTGC<br>ACCAGGTACTTCTACCGAACCG<br>TCCGAAGGCAGCGCTCCAGGTA<br>CCTCTACTGAACCTTCCGAGGG<br>CAGCGCTCCAGGTACCTCTACC<br>GAACCTTCTGAAGGTAGCGCAC<br>CAGGTAGCTCTACTCCGTCTGG<br>TGCAACCGGCTCCCCAGGTTCT<br>AGCCCGTCTGCTTCCACTGGTA<br>CTGGCCCAGGTGCTTCCCCGGG<br>CACCAGCTCTACTGGTTCTCCA<br>GGTAGCGAACCTGCTACCTCCG<br>GTTCTGAAACCCCAGGTACCTC<br>TGAAAGCGCAACTCCGGAGTCT<br>GGTCCAGGTAGCCCTGCAGGTT<br>CTCCTACCTCCACTGAGGAAGG<br>TAGCTCTACTCCGTCTGGTGCA<br>ACCGGCTCCCCAGGTTCTAGCC<br>CGTCTGCTTCCACTGGTACTGG<br>CCCAGGTGCTTCCCCGGGCACC<br>AGCTCTACTGGTTCTCCAGGTA<br>CCTCTGAAAGCGCTACTCCGGA<br>GTCTGGCCCAGGTACCTCTACT<br>GAACCGTCTGAGGGTAGCGCTC<br>CAGGTACTTCTACTGAACCGTC<br>CGAAGGTAGCGCACCA | |
| FVII-<br>AM1318 | ANAFLEELRPGSLE<br>RECKEEQCSFEEA<br>REIFKDAERTKLF<br>WISYSDGDQCASS<br>PCQNGGSCKDQLQ<br>SYICFCLPAFEGRN<br>CETHKDDQLICVN<br>ENGGCEQYCSDHT<br>GTKRSCRCHEGYS<br>LLADGVSCTPTVE<br>YPCGKIPILEKRNA<br>SKPQGRIVGGKVC<br>PKGECPWQVLLLV<br>NGAQLCGGTLINTI<br>WVVSAAHCFDKIK<br>NWRNLIAVLGEHD<br>LSEHDGDEQSRRV<br>AQVIIPSTYVPGTT<br>NHDIALLRLHQPV<br>VLTDHVVPLCLPE<br>RTFSERTLAFVRFS<br>LVSGWGQLLDRG<br>ATALELMVLNVPR<br>LMTQDCLQQSRK<br>VGDSPNITEYMFC<br>AGYSDGSKDSCKG<br>DSGGPHATHYRGT<br>WYLTGIVSWGQG<br>CATVGHFGVYTRV<br>SQYIEWLQKLMRS<br>EPRPGVLLRAPFPG | 684 | GCCAACGCGTTCCTGGAGGAGC<br>TACGGCCGGGCTCCCTGGAGAG<br>GGAGTGCAAGGAGGAGCAGTG<br>CTCCTTCGAGGAGGCCCGGGAG<br>ATCTTCAAGGACGCGGAGAGGA<br>CGAAGCTGTTCTGGATTTCTTAC<br>AGTGATGGGGACCAGTGTGCCT<br>CAAGTCCATGCCAGAATGGGGG<br>CTCCTGCAAGGACCAGCTCCAG<br>TCCTATATCTGCTTCTGCCTCCC<br>TGCCTTCGAGGGCCGGAACTGT<br>GAGACGCACAAGGATGACCAG<br>CTGATCTGTGTGAACGAGAACG<br>GCGGCTGTGAGCAGTACTGCAG<br>TGACCACACGGGCACCAAGCGC<br>TCCTGTCGGTGCCACGAGGGGT<br>ACTCTCTGCTGGCAGACGGGGT<br>GTCCTGCACACCCACAGTTGAA<br>TATCCATGTGGAAAAATACCTA<br>TTCTAGAAAAAAGAAATGCCAG<br>CAAACCCCAAGGCCGAATTGTG<br>GGGGGCAAGGTGTGCCCCAAA<br>GGGGAGTGTCCATGGCAGGTCC<br>TGTTGTTGGTGAATGGAGCTCA<br>GTTGTGTGGGGGGACCCTGATC<br>AACACCATCTGGGTGGTCTCCG<br>CGGCCCACTGTTTCGACAAAAT<br>CAAGAACTGGAGGAACCTGATC<br>GCGGTGCTGGGCGAGCACGACC<br>TCAGCGAGCACGACGGGGATG<br>AGCAGAGCCGGCGGGTGGCGC | 685 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | GTSTEPSEGSAPGS | | AGGTCATCATCCCCAGCACGTA | |
| | EPATSGSETPGSPA | | CGTCCCGGGCACCACCAACCAC | |
| | GSPTSTEEGSTSST | | GACATCGCGCTGCTCCGCCTGC | |
| | AESPGPGTSTPESG | | ACCAGCCCGTGGTCCTCACTGA | |
| | SASPGSTSESPSGT | | CCATGTGGTGCCCCTCTGCCTG | |
| | APGSTSESPSGTAP | | CCCGAACGGACGTTCTCTGAGA | |
| | GTSTPESGSASPGT | | GGACGCTGGCCTTCGTGCGCTT | |
| | STPESGSASPGSEP | | CTCATTGGTCAGCGGCTGGGGC | |
| | ATSGSETPGTSESA | | CAGCTGCTGGACCGTGGCGCCA | |
| | TPESGPGSPAGSPT | | CGGCCCTGGAGCTCATGGTCCT | |
| | STEEGTSTEPSEGS | | CAACGTGCCCCGGCTGATGACC | |
| | APGTSESATPESGP | | CAGGACTGCCTGCAGCAGTCAC | |
| | GTSTEPSEGSAPGT | | GGAAGGTGGGAGACTCCCCAA | |
| | STEPSEGSAPGSPA | | ATATCACGGAGTACATGTTCTG | |
| | GSPTSTEEGTSTEP | | TGCCGGCTACTCGGATGGCAGC | |
| | SEGSAPGTSTEPSE | | AAGGACTCCTGCAAGGGGGAC | |
| | GSAPGTSESATPES | | AGTGGAGGCCCACATGCCACCC | |
| | GPGTSESATPESGP | | ACTACCGGGGCACGTGGTACCT | |
| | GTSTEPSEGSAPGT | | GACGGGCATCGTCAGCTGGGGC | |
| | STEPSEGSAPGTSE | | CAGGGCTGCGCAACCGTGGGCC | |
| | SATPESGPGTSTEP | | ACTTTGGGGTGTACACCAGGGT | |
| | SEGSAPGSEPATSG | | CTCCCAGTACATCGAGTGGCTG | |
| | SETPGSPAGSPTST | | CAAAAGCTCATGCGCTCAGAGC | |
| | EEGSSTPSGATGSP | | CACGCCCAGGAGTCCTCCTGCG | |
| | GTPGSGTASSSPGS | | AGCCCCATTTCCCGGTGGTACT | |
| | STPSGATGSPGTST | | TCTACTGAACCGTCTGAAGGCA | |
| | EPSEGSAPGTSTEP | | GCGCACCAGGTAGCGAACCGGC | |
| | SEGSAPGSEPATSG | | TACTTCCGGTTCTGAAACCCCA | |
| | SETPGSPAGSPTST | | GGTAGCCCAGCAGGTTCTCCAA | |
| | EEGSPAGSPTSTEE | | CTTCTACTGAAGAAGGTTCTAC | |
| | GTSTEPSEGSAPGP | | CAGCTCTACCGCAGAATCTCCT | |
| | EPTGPAPSGGSEPA | | GGTCCAGGTACCTCTACTCCGG | |
| | TSGSETPGTSESAT | | AAAGCGGCTCTGCATCTCCAGG | |
| | PESGPGSPAGSPTS | | TTCTACTAGCGAATCTCCTTCTG | |
| | TEEGTSESATPESG | | GCACTGCACCAGGTTCTACTAG | |
| | PGSPAGSPTSTEEG | | CGAATCCCCGTCTGGTACTGCT | |
| | SPAGSPTSTEEGTS | | CCAGGTACTTCTACTCCTGAAA | |
| | ESATPESGPGSPAG | | GCGGTTCCGCTTCTCCAGGTAC | |
| | SPTSTEEGSPAGSP | | CTCTACTCCGGAAAGCGGTTCT | |
| | TSTEEGSTSSTAES | | GCATCTCCAGGTAGCGAACCGG | |
| | PGPGSTSESPSGTA | | CAACCTCCGGCTCTGAAACCCC | |
| | PGTSPSGESSTAPG | | AGGTACCTCTGAAAGCGCTACT | |
| | STSESPSGTAPGST | | CCTGAATCCGGCCCAGGTAGCC | |
| | SESPSGTAPGTSPS | | CGGCAGGTTCTCCGACTTCCAC | |
| | GESSTAPGTSTEPS | | TGAGGAAGGTACCTCTACTGAA | |
| | EGSAPGTSESATPE | | CCTTCTGAGGGCAGCGCTCCAG | |
| | SGPGTSESATPESG | | GTACTTCTGAAAGCGCTACCCC | |
| | PGSEPATSGSETPG | | GGAGTCCGGTCCAGGTACTTCT | |
| | TSESATPESGPGTS | | ACTGAACCGTCCGAAGGTAGCG | |
| | ESATPESGPGTSTE | | CACCAGGTACTTCTACCGAACC | |
| | PSEGSAPGTSESAT | | GTCCGAGGGTAGCGCACCAGGT | |
| | PESGPGTSTEPSEG | | AGCCCAGCAGGTTCTCCTACCT | |
| | SAPGTSPSGESSTA | | CCACCGAGGAAGGTACTTCTAC | |
| | PGTSPSGESSTAPG | | CGAACCGTCCGAGGGTAGCGCA | |
| | TSPSGESSTAPGTS | | CCAGGTACTTCTACCGAACCTT | |
| | TEPSEGSAPGSPAG | | CCGAGGGCAGCGCACCAGGTAC | |
| | SPTSTEEGTSTEPS | | TTCTGAAAGCGCTACCCCTGAG | |
| | EGSAPGSSPSASTG | | TCCGGCCCAGGTACTTCTGAAA | |
| | TGPGSSTPSGATGS | | GCGCTACTCCTGAATCCGGTCC | |
| | PGSSTPSGATGSPG | | AGGTACCTCTACTGAACCTTCC | |
| | SSTPSGATGSPGSS | | GAAGGCAGCGCTCCAGGTACCT | |
| | TPSGATGSPGASPG | | CTACCGAACCGTCCGAGGGCAG | |
| | TSSTGSPGASASGA | | CGCACCAGGTACTTCTGAAAGC | |
| | PSTGGTSPSGESST | | GCAACCCCTGAATCCGGTCCAG | |
| | APGSTSSTAESPGP | | GTACTTCTACTGAACCTTCCGA | |
| | GTSPSGESSTAPGT | | AGGTAGCGCTCCAGGTAGCGAA | |
| | SESATPESGPGTST | | CCTGCTACTTCTGGTTCTGAAAC | |
| | EPSEGSAPGTSTEP | | CCCAGGTAGCCCGGCTGGCTCT | |
| | SEGSAPGSSPSAST | | CCGACCTCCACCGAGGAAGGTA | |
| | GTGPGSSTPSGAT | | GCTCTACCCCGTCTGGTGCTACT | |
| | GSPGASPGTSSTGS | | GGTTCTCCAGGTACTCCGGGCA | |
| | PGTSTPESGSASPG | | GCGGTACTGCTTCTTCCTCTCCA | |
| | TSPSGESSTAPGTS | | GGTAGCTCTACCCCTTCTGGTG | |
| | PSGESSTAPGTSES | | CTACTGGCTCTCCAGGTACCTCT | |
| | ATPESGPGSEPATS | | ACCGAACCGTCCGAGGGTAGCG | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | GSETPGTSTEPSEG | | CACCAGGTACCTCTACTGAACC | |
| | SAPGSTSESPSGTA | | GTCTGAGGGTAGCGCTCCAGGT | |
| | PGSTSESPSGTAPG | | AGCGAACCGGCAACCTCCGGTT | |
| | TSTPESGSASPGSP | | CTGAAACTCCAGGTAGCCCTGC | |
| | AGSPTSTEEGTSES | | TGGCTCTCCGACTTCTACTGAG | |
| | ATPESGPGTSTEPS | | GAAGGTAGCCCGGCTGGTTCTC | |
| | EGSAPGSPAGSPTS | | CGACTTCTACTGAGGAAGGTAC | |
| | TEEGTSESATPESG | | TTCTACCGAACCTTCCGAAGGT | |
| | PGSEPATSGSETPG | | AGCGCTCCAGGTCCAGAACCAA | |
| | SSTPSGATGSPGAS | | CGGGGCCGGCCCCAAGCGGAG | |
| | PGTSSTGSPGSSTP | | GTAGCGAACCGGCAACCTCCGG | |
| | SGATGSPGSTSESP | | CTCTGAAACCCCAGGTACCTCT | |
| | SGTAPGTSPSGESS | | GAAAGCGCTACTCCTGAATCCG | |
| | TAPGSTSSTAESPG | | GCCCAGGTAGCCCGGCAGGTTC | |
| | PGSSTPSGATGSPG | | TCCGACTTCCACTGAGGAAGGT | |
| | ASPGTSSTGSPGTP | | ACTTCTGAAAGCGCTACTCCTG | |
| | GSGTASSSPGSPAG | | AGTCCGGCCCAGGTAGCCCGGC | |
| | SPTSTEEGSPAGSP | | TGGCTCTCCGACTTCCACCGAG | |
| | TSTEEGTSTEPSEG | | GAAGGTAGCCCGGCTGGCTCTC | |
| | SAP | | CAACTTCTACTGAAGAAGGTAC | |
| | | | TTCTGAAAGCGCTACTCCTGAG | |
| | | | TCCGGCCCAGGTAGCCCGGCTG | |
| | | | GCTCTCCGACTTCCACCGAGGA | |
| | | | AGGTAGCCCGGCTGGCTCTCCA | |
| | | | ACTTCTACTGAAGAAGGTTCTA | |
| | | | CCAGCTCTACCGCTGAATCTCC | |
| | | | TGGCCCAGGTTCTACTAGCGAA | |
| | | | TCTCCGTCTGGCACCGCACCAG | |
| | | | GTACTTCCCCTAGCGGTGAATC | |
| | | | TTCTACTGCACCAGGTTCTACC | |
| | | | AGCGAATCTCCTTCTGGCACCG | |
| | | | CTCCAGGTTCTACTAGCGAATC | |
| | | | CCCGTCTGGTACCGCACCAGGT | |
| | | | ACTTCTCCTAGCGGCGAATCTT | |
| | | | CTACCGCACCAGGTACTTCTAC | |
| | | | CGAACCTTCCGAGGGCAGCGCA | |
| | | | CCAGGTACTTCTGAAAGCGCTA | |
| | | | CCCCTGAGTCCGGCCCAGGTAC | |
| | | | TTCTGAAAGCGCTACTCCTGAA | |
| | | | TCCGGTCCAGGTAGCGAACCGG | |
| | | | CAACCTCTGGCTCTGAAACCCC | |
| | | | AGGTACCTCTGAAAGCGCTACT | |
| | | | CCGGAATCTGGTCCAGGTACTT | |
| | | | CTGAAAGCGCTACTCCGGAATC | |
| | | | CGGTCCAGGTACCTCTACTGAA | |
| | | | CCTTCTGAGGGCAGCGCTCCAG | |
| | | | GTACTTCTGAAAGCGCTACCCC | |
| | | | GGAGTCCGGTCCAGGTACTTCT | |
| | | | ACTGAACCGTCCGAAGGTAGCG | |
| | | | CACCAGGTACCTCCCCTAGCGG | |
| | | | CGAATCTTCTACTGCTCCAGGT | |
| | | | ACCTCTCCTAGCGGCGAATCTT | |
| | | | CTACCGCTCCAGGTACCTCCCC | |
| | | | TAGCGGTGAATCTTCTACCGCA | |
| | | | CCAGGTACTTCTACCGAACCGT | |
| | | | CCGAGGGTAGCGCACCAGGTAG | |
| | | | CCCAGCAGGTTCTCCTACCTCC | |
| | | | ACCGAGGAAGGTACTTCTACCG | |
| | | | AACCGTCCGAGGGTAGCGCACC | |
| | | | AGGTTCTAGCCCTTCTGCTTCCA | |
| | | | CCGGTACCGGCCCAGGTAGCTC | |
| | | | TACTCCGTCTGGTGCAACTGGC | |
| | | | TCTCCAGGTAGCTCTACTCCGTC | |
| | | | TGGTGCAACCGGCTCCCCAGGT | |
| | | | AGCTCTACCCCGTCTGGTGCTA | |
| | | | CCGGCTCTCCAGGTAGCTCTAC | |
| | | | CCCGTCTGGTGCAACCGGCTCC | |
| | | | CCAGGTGCATCCCCGGGTACTA | |
| | | | GCTCTACCGGTTCTCCAGGTGC | |
| | | | AAGCGCAAGCGGCGCGCCAAG | |
| | | | CACGGGAGGTACTTCTCCGAGC | |
| | | | GGTGAATCTTCTACCGCACCAG | |
| | | | GTTCTACTAGCTCTACCGCTGA | |
| | | | ATCTCCGGGCCCAGGTACTTCT | |
| | | | CCGAGCGGTGAATCTTCTACTG | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | CTCCAGGTACCTCTGAAAGCGC TACTCCGGAGTCTGGCCCAGGT ACCTCTACTGAACCGTCTGAGG GTAGCGCTCCAGGTACTTCTAC TGAACCGTCCGAAGGTAGCGCA CCAGGTTCTAGCCCTTCTGCATC TACTGGTACTGGCCCAGGTAGC TCTACTCCTTCTGGTGCTACCGG CTCTCCAGGTGCTTCTCCGGGT ACTAGCTCTACCGGTTCTCCAG GTACTTCTACTCCGGAAAGCGG TTCCGCATCTCCAGGTACTTCTC CTAGCGGTGAATCTTCTACTGC TCCAGGTACCTCTCCTAGCGGC GAATCTTCTACTGCTCCAGGTA CTTCTGAAAGCGCAACCCCTGA ATCCGGTCCAGGTAGCGAACCG GCTACTTCTGGCTCTGAGACTC CAGGTACTTCTACCGAACCGTC CGAAGGTAGCGCACCAGGTTCT ACCAGCGAATCCCCTTCTGGTA CTGCTCCAGGTTCTACCAGCGA ATCCCCTTCTGGCACCGCACCA GGTACTTCTACCCCTGAAAGCG GCTCCGCTTCTCCAGGTAGCCC GGCAGGCTCTCCGACCTCTACT GAGGAAGGTACTTCTGAAAGCG CAACCCCGGAGTCCGGCCCAGG TACCTCTACCGAACCGTCTGAG GGCAGCGCACCAGGTAGCCCTG CTGGCTCTCCAACCTCCACCGA AGAAGGTACCTCTGAAAGCGCA ACCCCTGAATCCGGCCCAGGTA GCGAACCGGCAACCTCCGGTTC TGAAACCCAGGTAGCTCTACC CCGTCTGGTGCTACCGGTTCCC CAGGTGCTTCTCCTGGTACTAG CTCTACCGGTTCTCCAGGTAGC TCTACCCCGTCTGGTGCTACTG GCTCTCCAGGTTCTACTAGCGA ATCCCCGTCTGGTACTGCTCCA GGTACTTCCCCTAGCGGTGAAT CTTCTACTGCTCCAGGTTCTACC AGCTCTACCGCAGAATCTCCGG GTCCAGGTAGCTCTACCCCTTCT GGTGCAACCGGCTCTCCAGGTG CATCCCCGGGTACCAGCTCTAC CGGTTCTCCAGGTACTCCGGGT AGCGGTACCGCTTCTTCCTCTCC AGGTAGCCCTGCTGGCTCTCCG ACTTCTACTGAGGAAGGTAGCC CGGCTGGTTCTCCGACTTCTACT GAGGAAGGTACTTCTACCGAAC CTTCCGAAGGTAGCGCTCCA | |
| FIX-AE288 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY | 686 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAGAGTTTCTGTTTCACAAA CTTCTAAGCTCACCCGTGCTGA | 687 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | NAAINKYNHDIAL | | GACTGTTTTCCTGATGTGGACT | |
| | LELDEPLVLNSYV | | ATGTAAATTCTACTGAAGCTGA | |
| | TPICIADKEYTNIFL | | AACCATTTTGGATAACATCACT | |
| | KFGSGYVSGWGR | | CAAAGCACCCAATCATTTAATG | |
| | VFHKGRSALVLQY | | ACTTCACTCGGGTTGTTGGTGG | |
| | LRVPLVDRATCLR | | AGAAGATGCCAAACCAGGTCA | |
| | STKFTIYNNMFCA | | ATTCCCTTGGCAGGTTGTTTTGA | |
| | GFHEGGRDSCQGD | | ATGGTAAAGTTGATGCATTCTG | |
| | SGGPHVTEVEGTS | | TGGAGGCTCTATCGTTAATGAA | |
| | FLTGIISWGEECAM | | AAATGGATTGTAACTGCTGCCC | |
| | KGKYGIYTKVSRY | | ACTGTGTTGAAACTGGTGTTAA | |
| | VNWIKEKTKLTGG | | AATTACAGTTGTCGCAGGTGAA | |
| | TSESATPESGPGSE | | CATAATATTGAGGAGACAGAAC | |
| | PATSGSETPGTSES | | ATACAGAGCAAAAGCGAAATG | |
| | ATPESGPGSEPATS | | TGATTCGAATTATTCCTCACCAC | |
| | GSETPGTSESATPE | | AACTACAATGCAGCTATTAATA | |
| | SGPGTSTEPSEGSA | | AGTACAACCATGACATTGCCCT | |
| | PGSPAGSPTSTEEG | | TCTGGAACTGGACGAACCCTTA | |
| | TSESATPESGPGSE | | GTGCTAAACAGCTACGTTACAC | |
| | PATSGSETPGTSES | | CTATTTGCATTGCTGACAAGGA | |
| | ATPESGPGSPAGSP | | ATACACGAACATCTTCCTCAAA | |
| | TSTEEGSPAGSPTS | | TTTGGATCTGGCTATGTAAGTG | |
| | TEEGTSTEPSEGSA | | GCTGGGGAAGAGTCTTCCACAA | |
| | PGTSESATPESGPG | | AGGGAGATCAGCTTTAGTTCTT | |
| | TSESATPESGPGTS | | CAGTACCTTAGAGTTCCACTTG | |
| | ESATPESGPGSEPA | | TTGACCGAGCCACATGTCTTCG | |
| | TSGSETPGSEPATS | | ATCTACAAAGTTCACCATCTAT | |
| | GSETPGSPAGSPTS | | AACAACATGTTCTGTGCTGGCT | |
| | TEEGTSTEPSEGSA | | TCCATGAAGGAGGTAGAGATTC | |
| | PGTSTEPSEGSAPG | | ATGTCAAGGAGATAGTGGGGG | |
| | SEPATSGSETPGTS | | ACCCCATGTTACTGAAGTGGAA | |
| | ESATPESGPGTSTE | | GGGACCAGTTTCTTAACTGGAA | |
| | PSEGSAP | | TTATTAGCTGGGGTGAAGAGTG | |
| | | | TGCAATGAAAGGCAAATATGGA | |
| | | | ATATATACCAAGGTATCCCGGT | |
| | | | ATGTCAACTGGATTAAGGAAAA | |
| | | | AACAAAGCTCACTGGGGTGGTA | |
| | | | CCTCTGAAAGCGCAACTCCTGA | |
| | | | GTCTGGCCCAGGTAGCGAACCT | |
| | | | GCTACCTCCGGCTCTGAGACTC | |
| | | | CAGGTACCTCTGAAAGCGCAAC | |
| | | | CCCGGAATCTGGTCCAGGTAGC | |
| | | | GAACCTGCAACCTCTGGCTCTG | |
| | | | AAACCCCAGGTACCTCTGAAAG | |
| | | | CGCTACTCCTGAATCTGGCCCA | |
| | | | GGTACTTCTACTGAACCGTCCG | |
| | | | AGGGCAGCGCACCAGGTAGCCC | |
| | | | TGCTGGCTCTCCAACCTCCACC | |
| | | | GAAGAAGGTACCTCTGAAAGCG | |
| | | | CAACCCCTGAATCCGGCCCAGG | |
| | | | TAGCGAACCGGCAACCTCCGGT | |
| | | | TCTGAAACCCCAGGTACTTCTG | |
| | | | AAAGCGCTACTCCTGAGTCCGG | |
| | | | CCCAGGTAGCCCGGCTGGCTCT | |
| | | | CCGACTTCCACCGAGGAAGGTA | |
| | | | GCCCGGCTGGCTCTCCAACTTC | |
| | | | TACTGAAGAAGGTACTTCTACC | |
| | | | GAACCTTCCGAGGGCAGCGCAC | |
| | | | CAGGTACTTCTGAAAGCGCTAC | |
| | | | CCCTGAGTCCGGCCCAGGTACT | |
| | | | TCTGAAAGCGCTACTCCTGAAT | |
| | | | CCGGTCCAGGTACTTCTGAAAG | |
| | | | CGCTACCCCGGAATCTGGCCCA | |
| | | | GGTAGCGAACCGGCTACTTCTG | |
| | | | GTTCTGAAACCCCAGGTAGCGA | |
| | | | ACCGGCTACCTCCGGTTCTGAA | |
| | | | ACTCCAGGTAGCCCAGCAGGCT | |
| | | | CTCCGACTTCCACTGAGGAAGG | |
| | | | TACTTCTACTGAACCTTCCGAA | |
| | | | GGCAGCGCACCAGGTACCTCTA | |
| | | | CTGAACCTTCTGAGGGCAGCGC | |
| | | | TCCAGGTAGCGAACCTGCAACC | |
| | | | TCTGGCTCTGAAACCCCAGGTA | |
| | | | CCTCTGAAAGCGCTACTCCTGA | |
| | | | ATCTGGCCCAGGTACTTCTACT | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | GAACCGTCCGAGGGCAGCGCAC CA | |
| FIX-AE864 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGG SPAGSPTSTEEGTS ESATPESGPGTSTE PSEGSAPGSPAGSP TSTEEGTSTEPSEG SAPGTSTEPSEGSA PGTSESATPESGPG SEPATSGSETPGSE PATSGSETPGSPAG SPTSTEEGTSESAT PESGPGTSTEPSEG SAPGTSTEPSEGSA PGSPAGSPTSTEEG TSTEPSEGSAPGTS TEPSEGSAPGTSES ATPESGPGTSTEPS EGSAPGTSESATPE SGPGSEPATSGSET PGTSTEPSEGSAPG TSTEPSEGSAPGTS ESATPESGPGTSES ATPESGPGSPAGSP TSTEEGTSESATPE SGPGSEPATSGSET PGTSESATPESGPG TSTEPSEGSAPGTS TEPSEGSAPGTSTE PSEGSAPGTSTEPS EGSAPGTSTEPSEG SAPGTSTEPSEGSA PGSPAGSPTSTEEG TSTEPSEGSAPGTS ESATPESGPGSEPA TSGSETPGTSESAT PESGPGSEPATSGS ETPGTSESATPESG PGTSTEPSEGSAPG TSESATPESGPGSP AGSPTSTEEGSPAG SPTSTEEGSPAGSP TSTEEGTSESATPE | 688 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGTGGTA GCCCGGCTGGCTCTCCTACCTCT ACTGAGGAAGGTACTTCTGAAA GCGCTACTCCTGAGTCTGGTCC AGGTACCTCTACTGAACCGTCC GAAGGTAGCGCTCCAGGTAGCC CAGCAGGCTCTCCGACTTCCAC TGAGGAAGGTACTTCTACTGAA CCTTCCGAAGGCAGCGCACCAG GTACCTCTACTGAACCTTCTGA GGGCAGCGCTCCAGGTACTTCT GAAAGCGCTACCCCGGAATCTG GCCCAGGTAGCGAACCGGCTAC TTCTGGTTCTGAAACCCCAGGT AGCGAACCGGCTACCTCCGGTT CTGAAACTCCAGGTAGCCCGGC | 689 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | SGPGTSTEPSEGSA PGTSESATPESGPG SEPATSGSETPGTS ESATPESGPGSEPA TSGSETPGTSESAT PESGPGTSTEPSEG SAPGSPAGSPTSTE EGTSESATPESGPG SEPATSGSETPGTS ESATPESGPGSPAG SPTSTEEGSPAGSP TSTEEGTSTEPSEG SAPGTSESATPESG PGTSESATPESGPG TSESATPESGPGSE PATSGSETPGSEPA TSGSETPGSPAGSP TSTEEGTSTEPSEG SAPGTSTEPSEGSA PGSEPATSGSETPG TSESATPESGPGTS TEPSEGSAP | | AGGCTCTCCGACCTCTACTGAG GAAGGTACTTCTGAAAGCGCAA CCCCGGAGTCCGGCCCAGGTAC CTCTACCGAACCGTCTGAGGGC AGCGCACCAGGTACTTCTACCG AACCGTCCGAGGGTAGCGCACC AGGTAGCCCAGCAGGTTCTCCT ACCTCCACCGAGGAAGGTACTT CTACCGAACCGTCCGAGGGTAG CGCACCAGGTACCTCTACTGAA CCTTCTGAGGGCAGCGCTCCAG GTACTTCTGAAAGCGCTACCCC GGAGTCCGGTCCAGGTACTTCT ACTGAACCGTCCGAAGGTAGCG CACCAGGTACTTCTGAAAGCGC AACCCCTGAATCCGGTCCAGGT AGCGAACCGGCTACTTCTGGCT CTGAGACTCCAGGTACTTCTAC CGAACCGTCCGAAGGTAGCGCA CCAGGTACTTCTACTGAACCGT CTGAAGGTAGCGCACCAGGTAC TTCTGAAAGCGCAACCCCGGAA TCCGGCCCAGGTACCTCTGAAA GCGCAACCCCGGAGTCCGGCCC AGGTAGCCCTGCTGGCTCTCCA ACCTCCACCGAAGAAGGTACCT CTGAAAGCGCAACCCCTGAATC CGGCCCAGGTAGCGAACCGGCA ACCTCCGGTTCTGAAACCCCAG GTACCTCTGAAAGCGCTACTCC GGAGTCTGGCCCAGGTACCTCT ACTGAACCGTCTGAGGGTAGCG CTCCAGGTACTTCTACTGAACC GTCCGAAGGTAGCGCACCAGGT ACTTCTACCGAACCGTCCGAAG GCAGCGCTCCAGGTACCTCTAC TGAACCTTCCGAGGGCAGCGCT CCAGGTACCTCTACCGAACCTT CTGAAGGTAGCGCACCAGGTAC TTCTACCGAACCGTCCGAGGGT AGCGCACCAGGTAGCCCAGCAG GTTCTCCTACCTCCACCGAGGA AGGTACTTCTACCGAACCGTCC GAGGGTAGCGCACCAGGTACCT CTGAAAGCGCAACTCCTGAGTC TGGCCCAGGTAGCGAACCTGCT ACCTCCGGCTCTGAGACTCCAG GTACCTCTGAAAGCGCAACCCC GGAATCTGGTCCAGGTAGCGAA CCTGCAACCTCTGGCTCTGAAA CCCCAGGTACCTCTGAAAGCGC TACTCCTGAATCTGGCCCAGGT ACTTCTACTGAACCGTCCGAGG GCAGCGCACCAGGTACTTCTGA AAGCGCTACTCCTGAGTCCGGC CCAGGTAGCCCGGCTGGCTCTC CGACTTCCACCGAGGAAGGTAG CCCGGCTGGCTCTCCAACTTCT ACTGAAGAAGGTAGCCCGGCA GGCTCTCCGACCTCTACTGAGG AAGGTACTTCTGAAAGCGCAAC CCCGGAGTCCGGCCCAGGTACC TCTACCGAACCGTCTGAGGGCA GCGCACCAGGTACCTCTGAAAG CGCAACTCCTGAGTCTGGCCCA GGTAGCGAACCTGCTACCTCCG GCTCTGAGACTCCAGGTACCTC TGAAAGCGCAACCCCGGAATCT GGTCCAGGTAGCGAACCTGCAA CCTCTGGCTCTGAAACCCCAGG TACCTCTGAAAGCGCTACTCCT GAATCTGGCCCAGGTACTTCTA CTGAACCGTCCGAGGGCAGCGC ACCAGGTAGCCCTGCTGGCTCT CCAACCTCCACCGAAGAAGGTA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | CCTCTGAAAGCGCAACCCCTGA | |
| | | | ATCCGGCCCAGGTAGCGAACCG | |
| | | | GCAACCTCCGGTTCTGAAACCC | |
| | | | CAGGTACTTCTGAAAGCGCTAC | |
| | | | TCCTGAGTCCGGCCCAGGTAGC | |
| | | | CCGGCTGGCTCTCCGACTTCCA | |
| | | | CCGAGGAAGGTAGCCCGGCTGG | |
| | | | CTCTCCAACTTCTACTGAAGAA | |
| | | | GGTACTTCTACCGAACCTTCCG | |
| | | | AGGGCAGCGCACCAGGTACTTC | |
| | | | TGAAAGCGCTACCCCTGAGTCC | |
| | | | GGCCCAGGTACTTCTGAAAGCG | |
| | | | CTACTCCTGAATCCGGTCCAGG | |
| | | | TACTTCTGAAAGCGCTACCCCG | |
| | | | GAATCTGGCCCAGGTAGCGAAC | |
| | | | CGGCTACTTCTGGTTCTGAAAC | |
| | | | CCCAGGTAGCGAACCGGCTACC | |
| | | | TCCGGTTCTGAAACTCCAGGTA | |
| | | | GCCCAGCAGGCTCTCCGACTTC | |
| | | | CACTGAGGAAGGTACTTCTACT | |
| | | | GAACCTTCCGAAGGCAGCGCAC | |
| | | | CAGGTACCTCTACTGAACCTTC | |
| | | | TGAGGGCAGCGCTCCAGGTAGC | |
| | | | GAACCTGCAACCTCTGGCTCTG | |
| | | | AAACCCCAGGTACCTCTGAAAG | |
| | | | CGCTACTCCTGAATCTGGCCCA | |
| | | | GGTACTTCTACTGAACCGTCCG | |
| | | | AGGGCAGCGCACCA | |
| FIX-AF864 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GPHEGGRDSCQGD SGGPHVTEVEGTS FLTGIISWGEECAM KGKYGIYTKVSRY VNWIKEKTKLTGG STSESPSGTAPGTS PSGESSTAPGSTSE SPSGTAPGSTSESP SGTAPGTSTPESGS ASPGTSTPESGSAS PGSTSESPSGTAPG STSESPSGTAPGTS PSGESSTAPGSTSE SPSGTAPGTSPSGE SSTAPGTSPSGESS TAPGSTSSTAESPG PGTSPSGESSTAPG TSPSGESSTAPGST SSTAESPGPGTSTP | 690 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG | 691 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | ESGSASPGTSTPES | | ATCTACAAAGTTCACCATCTAT | |
| | GSASPGSTSESPSG | | AACAACATGTTCTGTGCTGGCT | |
| | TAPGSTSESPSGTA | | TCCATGAAGGAGGTAGAGATTC | |
| | PGTSTPESGSASPG | | ATGTCAAGGAGATAGTGGGGG | |
| | STSSTAESPGPGTS | | ACCCCATGTTACTGAAGTGGAA | |
| | TPESGSASPGSTSE | | GGGACCAGTTTCTTAACTGGAA | |
| | SPSGTAPGTSPSGE | | TTATTAGCTGGGGTGAAGAGTG | |
| | SSTAPGSTSSTAES | | TGCAATGAAAGGCAAATATGGA | |
| | PGPGTSPSGESSTA | | ATATATACCAAGGTATCCCGGT | |
| | PGTSTPESGSASPG | | ATGTCAACTGGATTAAGGAAAA | |
| | STSSTAESPGPGST | | AACAAAGCTCACTGGGGTGGTT | |
| | SSTAESPGPGSTSS | | CTACCAGCGAATCTCCTTCTGG | |
| | TAESPGPGSTSSTA | | CACCGCTCCAGGTACCTCTCCT | |
| | ESPGPGTSPSGESS | | AGCGGCGAATCTTCTACCGCTC | |
| | TAPGSTSESPSGTA | | CAGGTTCTACTAGCGAATCTCC | |
| | PGSTSESPGSTAPG | | TTCTGGCACTGCACCAGGTTCT | |
| | TSTPESGPXXXGA | | ACTAGCGAATCCCCGTCTGGTA | |
| | SASGAPSTXXXXS | | CTGCTCCAGGTACTTCTACTCCT | |
| | ESPSGTAPGSTSES | | GAAAGCGGTTCCGCTTCTCCAG | |
| | PSGTAPGSTSESPS | | GTACCTCTACTCCGGAAAGCGG | |
| | GTAPGSTSESPSGT | | TTCTGCATCTCCAGGTTCTACCA | |
| | APGSTSESPSGTAP | | GCGAATCTCCTTCTGGCACCGC | |
| | GSTSESPSGTAPGT | | TCCAGGTTCTACTAGCGAATCC | |
| | STPESGSASPGTSP | | CCGTCTGGTACCGCACCAGGTA | |
| | SGESSTAPGTSPSG | | CTTCTCCTAGCGGCGAATCTTCT | |
| | ESSTAPGSTSSTAE | | ACCGCACCAGGTTCTACTAGCG | |
| | SPGPGTSPSGESST | | AATCTCCGTCTGGCACTGCTCC | |
| | APGTSTPESGSASP | | AGGTACTTCTCCTAGCGGTGAA | |
| | GSTSESPSGTAPGS | | TCTTCTACCGCTCCAGGTACTTC | |
| | TSESPSGTAPGTSP | | CCCTAGCGGCGAATCTTCTACC | |
| | SGESSTAPGSTSES | | GCTCCAGGTTCTACTAGCTCTA | |
| | PSGTAPGTSTPESG | | CTGCAGAATCTCCGGGCCCAGG | |
| | SASPGTSTPESGSA | | TACCTCTCCTAGCGGTGAATCTT | |
| | SPGSTSESPSGTAP | | CTACCGCTCCAGGTACTTCTCC | |
| | GTSTPESGSASPGS | | GAGCGGTGAATCTTCTACCGCT | |
| | TSSTAESPGPGSTS | | CCAGGTTCTACTAGCTCTACTG | |
| | ESPSGTAPGSTSES | | CAGAATCTCCTGGCCCAGGTAC | |
| | PSGTAPGTSPSGES | | CTCTACTCCGGAAAGCGGCTCT | |
| | STAPGSTSSTAESP | | GCATCTCCAGGTACTTCTACCCC | |
| | GPGTSPSGESSTAP | | CTGAAAGCGGTTCTGCATCTCC | |
| | GTSTPESGSASPGT | | AGGTTCTACTAGCGAATCTCCT | |
| | SPSGESSTAPGTSP | | TCTGGCACTGCACCAGGTTCTA | |
| | SGESSTAPGTSPSG | | CCAGCGAATCTCCGTCTGGCAC | |
| | ESSTAPGSTSSTAE | | TGCACCAGGTACCTCTACCCCT | |
| | SPGPGSTSSTAESP | | GAAAGCGGTTCCGCTTCTCCAG | |
| | GPGTSPSGESSTAP | | GTTCTACCAGCTCTACCGCAGA | |
| | GSSPSASTGTGPGS | | ATCTCCTGGTCCAGGTACCTCT | |
| | STPSGATGSPGSST | | ACTCCGGAAAGCGGCTCTGCAT | |
| | PSGATGSP | | CTCCAGGTTCTACTAGCGAATC | |
| | | | TCCTTCTGGCACTGCACCAGGT | |
| | | | ACTTCTCCGAGCGGTGAATCTT | |
| | | | CTACCGCACCAGGTTCTACTAG | |
| | | | CTCTACCGCTGAATCTCCGGGC | |
| | | | CCAGGTACTTCTCCGAGCGGTG | |
| | | | AATCTTCTACTGCTCCAGGTAC | |
| | | | CTCTACTCCTGAAAGCGGTTCT | |
| | | | GCATCTCCAGGTTCCACTAGCT | |
| | | | CTACCGCAGAATCTCCGGGCCC | |
| | | | AGGTTCTACTAGCTCTACTGCT | |
| | | | GAATCTCCTGGCCCAGGTTCTA | |
| | | | CTAGCTCTACTGCTGAATCTCC | |
| | | | GGGTCCAGGTTCTACCAGCTCT | |
| | | | ACTGCTGAATCTCCTGGTCCAG | |
| | | | GTACCTCCCCGAGCGGTGAATC | |
| | | | TTCTACTGCACCAGGTTCTACTA | |
| | | | GCGAATCTCCTTCTGGCACTGC | |
| | | | ACCAGGTTCTACCAGCGAATCT | |
| | | | CCGTCTGGCACTGCACCAGGTA | |
| | | | CCTCTACCCCTGAAAGCGGTCC | |
| | | | XXXXXXXXXXXXXTGCAAGCGC | |
| | | | AAGCGGCGCGCCAAGCACGGG | |
| | | | AXXXXXXXXXTAGCGAATCTCCT | |
| | | | TCTGGTACCGCTCCAGGTTCTA | |
| | | | CCAGCGAATCCCCGTCTGGTAC | |
| | | | TGCTCCAGGTTCTACCAGCGAA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | TCTCCTTCTGGTACTGCACCAG GTTCTACTAGCGAATCTCCTTCT GGTACCGCTCCAGGTTCTACCA GCGAATCCCCGTCTGGTACTGC TCCAGGTTCTACCAGCGAATCT CCTTCTGGTACTGCACCAGGTA CTTCTACTCCGGAAAGCGGTTC CGCATCTCCAGGTACTTCTCCTA GCGGTGAATCTTCTACTGCTCC AGGTACCTCTCCTAGCGGCGAA TCTTCTACTGCTCCAGGTTCTAC CAGCTCTACTGCTGAATCTCCG GGTCCAGGTACTTCCCCGAGCG GTGAATCTTCTACTGCACCAGG TACTTCTACTCCGGAAAGCGGT TCCGCTTCTCCAGGTTCTACCAG CGAATCTCCTTCTGGCACCGCT CCAGGTTCTACTAGCGAATCCC CGTCTGGTACCGCACCAGGTAC TTCTCCTAGCGGAATCTTCTA CCGCACCAGGTTCTACTAGCGA ATCCCCGTCTGGTACCGCACCA GGTACTTCTACCCCGGAAAGCG GCTCTGCTTCTCCAGGTACTTCT ACCCCGGAAAGCGGCTCCGCAT CTCCAGGTTCTACTAGCGAATC TCCTTCTGGTACCGCTCCAGGT ACTTCTACCCCTGAAAGCGGCT CCGCTTCTCCAGGTTCCACTAG CTCTACCGCTGAATCTCCGGGT CCAGGTTCTACCAGCGAATCTC CTTCTGGCACCGCTCCAGGTTCT ACTAGCGAATCCCCGTCTGGTA CCGCACCAGGTACTTCTCCTAG CGGCGAATCTTCTACCGCACCA GGTTCTACCAGCTCTACTGCTG AATCTCCGGGTCCAGGTACTTC CCCGAGCGGTGAATCTTCTACT GCACCAGGTACTTCTACTCCGG AAAGCGGTTCCGCTTCTCCAGG TACCTCCCCTAGCGGCGAATCT TCTACTGCTCCAGGTACCTCTCC TAGCGGCGAATCTTCTACCGCT CCAGGTACCTCCCCTAGCGGTG AATCTTCTACCGCACCAGGTTC TACTAGCTCTACTGCTGAATCTC CGGGTCCAGGTTCTACCAGCTC TACTGCTGAATCTCCTGGTCCA GGTACCTCCCCGAGCGGTGAAT CTTCTACTGCACCAGGTTCTAG CCCTTCTGCTTCCACCGGTACCG GCCCAGGTAGCTCTACTCCGTC TGGTGCAACTGGCTCTCCAGGT AGCTCTACTCCGTCTGGTGCAA CCGGCTCCCCA | |
| FIX-AG864 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE | 692 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAAGAGTTTCTGTTTCACAAA | 693 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | QKRNVIRIIPHHNY | | CTTCTAAGCTCACCCGTGCTGA | |
| | NAAINKYNHDIAL | | GACTGTTTTTCCTGATGTGGACT | |
| | LELDEPLVLNSYV | | ATGTAAATTCTACTGAAGCTGA | |
| | TPICIADKEYTNIFL | | AACCATTTTGGATAACATCACT | |
| | KFGSGYVSGWGR | | CAAAGCACCCAATCATTTAATG | |
| | VFHKGRSALVLQY | | ACTTCACTCGGGTTGTTGGTGG | |
| | LRVPLVDRATCLR | | AGAAGATGCCAAACCAGGTCA | |
| | STKFTIYNNMFCA | | ATTCCCTTGGCAGGTTGTTTTGA | |
| | GFHEGGRDSCQGD | | ATGGTAAAGTTGATGCATTCTG | |
| | SGGPHVTEVEGTS | | TGGAGGCTCTATCGTTAATGAA | |
| | FLTGIISWGEECAM | | AAATGGATTGTAACTGCTGCCC | |
| | KGKYGIYTKVSRY | | ACTGTGTTGAAACTGGTGTTAA | |
| | VNWIKEKTKLTGG | | AATTACAGTTGTCGCAGGTGAA | |
| | ASPGTSSTGSPGSS | | CATAATATTGAGGAGACAGAAC | |
| | PSASTGTGPGSSPS | | ATACAGAGCAAAAGCGAAATG | |
| | ASTGTGPGTPGSG | | TGATTCGAATTATTCCTCACCAC | |
| | TASSSPGSSTPSGA | | AACTACAATGCAGCTATTAATA | |
| | TGSPGSNPSASTGT | | AGTACAACCATGACATTGCCCT | |
| | GPGASPGTSSTGSP | | TCTGGAACTGGACGAACCCTTA | |
| | GTPGSGTASSSPGS | | GTGCTAAACAGCTACGTTACAC | |
| | STPSGATGSPGTPG | | CTATTTGCATTGCTGACAAGGA | |
| | SGTASSSPGASPGT | | ATACACGAACATCTTCCTCAAA | |
| | SSTGSPGASPGTSS | | TTTGGATCTGGCTATGTAAGTG | |
| | TGSPGTPGSGTASS | | GCTGGGGAAGAGTCTTCCACAA | |
| | SPGSSTPSGATGSP | | AGGGAGATCAGCTTTAGTTCTT | |
| | GASPGTSSTGSPGT | | CAGTACCTTAGAGTTCCACTTG | |
| | PGSGTASSSPGSST | | TTGACCGAGCCACATGTCTTCG | |
| | PSGATGSPGSNPSA | | ATCTACAAAGTTCACCATCTAT | |
| | STGTGPGSSPSAST | | AACAACATGTTCTGTGCTGGCT | |
| | GTGPGSSTPSGAT | | TCCATGAAGGAGGTAGAGATTC | |
| | GSPGSSTPSGATGS | | ATGTCAAGGAGATAGTGGGGG | |
| | PGASPGTSSTGSPG | | ACCCCATGTTACTGAAGTGGAA | |
| | ASPGTSSTGSPGAS | | GGGACCAGTTTCTTAACTGGAA | |
| | PGTSSTGSPGTPGS | | TTATTAGCTGGGGTGAAGAGTG | |
| | GTASSSPGASPGTS | | TGCAATGAAAGGCAAATATGGA | |
| | STGSPGASPGTSST | | ATATATACCAAGGTATCCCGGT | |
| | GSPGASPGTSSTGS | | ATGTCAACTGGATTAAGGAAAA | |
| | PGSSPSASTGTGPG | | AACAAAGCTCACTGGGGTGGTG | |
| | TPGSGTASSSPGAS | | CTTCCCCGGGCACCAGCTCTAC | |
| | PGTSSTGSPGASPG | | TGGTTCTCCAGGTTCTAGCCCGT | |
| | TSSTGSPGASPGTS | | CTGCTTCTACTGGTACTGGTCCA | |
| | STGSPGSSTPSGAT | | GGTTCTAGCCCTTCTGCTTCCAC | |
| | GSPGSSTPSGATGS | | TGGTACTGGTCCAGGTACCCCG | |
| | PGASPGTSSTGSPG | | GGTAGCGGTACCGCTTCTTCTTC | |
| | TPGSGTASSSPGSS | | TCCAGGTAGCTCTACTCCGTCT | |
| | TPSGATGSPGSSTP | | GGTGCTACCGGCTCTCCAGGTT | |
| | SGATGSPGSSTPSG | | CTAACCCTTCTGCATCCACCGG | |
| | ATGSPGSSPSASTG | | TACCGGCCCAGGTGCTTCTCCG | |
| | TGPGASPGTSSTGS | | GGCACCAGCTCTACTGGTTCTC | |
| | PGASPGTSSTGSPG | | CAGGTACCCCGGGCAGCGGTAC | |
| | TPGSGTASSSPGAS | | CGCATCTTCTTCTCCAGGTAGCT | |
| | PGTSSTGSPGASPG | | CTACTCCTTCTGGTGCAACTGGT | |
| | TSSTGSPGASPGTS | | TCTCCAGGTACTCCTGGCAGCG | |
| | STGSPGASPGTSST | | GTACCGCTTCTTCTTCTCCAGGT | |
| | GSPGTPGSGTASSS | | GCTTCTCCTGGTACTAGCTCTAC | |
| | PGSSTPSGATGSPG | | TGGTTCTCCAGGTGCTTCTCCGG | |
| | TPGSGTASSSPGSS | | GCACTAGCTCTACTGGTTCTCC | |
| | TPSGATGSPGTPGS | | AGGTACCCGGGTAGCGGTACT | |
| | GTASSSPGSSTPSG | | GCTTCTTCCTCTCCAGGTAGCTC | |
| | ATGSPGSSTPSGAT | | TACCCCTTCTGGTGCAACCGGC | |
| | GSPGSSPSASTGTG | | TCTCCAGGTGCTTCTCCGGGCA | |
| | PGSSPSASTGTGPG | | CCAGCTCTACCGGTTCTCCAGG | |
| | ASPGTSSTGSPGTP | | TACCCCGGGTAGCGGTACCGCT | |
| | GSGTASSSPGSSTP | | TCTTCTTCTCCAGGTAGCTCTAC | |
| | SGATGSPGSSPSAS | | TCCGTCTGGTGCTACCGGCTCTC | |
| | TGTGPGSSPSASTG | | CAGGTTCTAACCCTTCTGCATCC | |
| | TGPGASPGTSSTGS | | ACCGGTACCGGCCCAGGTTCTA | |
| | PGASPGTSSTGSPG | | GCCCTTCTGCTTCCACCGGTACT | |
| | SSTPSGATGSPGSS | | GGCCCAGGTAGCTCTACCCCTT | |
| | PSASTGTGPGASPG | | CTGGTGCTACCGGCTCCCCAGG | |
| | TSSTGSPGSSPSAS | | TAGCTCTACTCCTTCTGGTGCAA | |
| | TGTGPGTPGSGTA | | CTGGCTCTCCAGGTGCATCTCC | |
| | SSSPGSSTPSGATG | | GGGCACTAGCTCTACTGGTTCT | |
| | SPGSSTPSGATGSP | | CCAGGTGCATCCCCTGGCACTA | |
| | GASPGTSSTGSP | | GCTCTACTGGTTCTCCAGGTGCT | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | TCTCCTGGTACCAGCTCTACTG GTTCTCCAGGTACTCCTGGCAG CGGTACCGCTTCTTCTTCTCCAG GTGCTTCTCCTGGTACTAGCTCT ACTGGTTCTCCAGGTGCTTCTCC GGGCACTAGCTCTACTGGTTCT CCAGGTGCTTCCCCGGGCACTA GCTCTACCGGTTCTCCAGGTTCT AGCCCTTCTGCATCTACTGGTA CTGGCCCAGGTACTCCGGGCAG CGGTACTGCTTCTTCCTCTCCAG GTGCATCTCCGGGCACTAGCTC TACTGGTTCTCCAGGTGCATCC CCTGGCACTAGCTCTACTGGTT CTCCAGGTGCTTCTCCTGGTACC AGCTCTACTGGTTCTCCAGGTA GCTCTACTCCGTCTGGTGCAAC CGGTTCCCCAGGTAGCTCTACT CCTTCTGGTGCTACTGGCTCCCC AGGTGCATCCCCTGGCACCAGC TCTACCGGTTCTCCAGGTACCC CGGGCAGCGGTACCGCATCTTC CTCTCCAGGTAGCTCTACCCCG TCTGGTGCTACCGGTTCCCCAG GTAGCTCTACCCCGTCTGGTGC AACCGGCTCCCCAGGTAGCTCT ACTCCGTCTGGTGCAACCGGCT CCCCAGGTTCTAGCCCGTCTGC TTCCACTGGTACTGGCCCAGGT GCTTCCCCGGGCACCAGCTCTA CTGGTTCTCCAGGTGCATCCCC GGGTACCAGCTCTACCGGTTCT CCAGGTACTCCTGGCAGCGGTA CTGCATCTTCCTCTCCAGGTGCT TCTCCGGGCACCAGCTCTACTG GTTCTCCAGGTGCATCTCCGGG CACTAGCTCTACTGGTTCTCCA GGTGCATCCCCTGGCACTAGCT CTACTGGTTCTCCAGGTGCTTCT CCTGGTACCAGCTCTACTGGTT CTCCAGGTACCCCTGGTAGCGG TACTGCTTCTTCCTCTCCAGGTA GCTCTACTCCGTCTGGTGCTACC GGTTCTCCAGGTACCCCGGGTA GCGGTACCGCATCTTCTTCTCCA GGTAGCTCTACCCCGTCTGGTG CTACTGGTTCTCCAGGTACTCC GGGCAGCGGTACTGCTTCTTCC TCTCCAGGTAGCTCTACCCCTTC TGGTGCTACTGGCTCTCCAGGT AGCTCTACCCCGTCTGGTGCTA CTGGCTCCCCAGGTTCTAGCCC TTCTGCATCCACCGGTACCGGT CCAGGTTCTAGCCCGTCTGCAT CTACTGGTACTGGTCCAGGTGC ATCCCCGGGCACTAGCTCTACC GGTTCTCCAGGTACTCCTGGTA GCGGTACTGCTTCTTCTTCTCCA GGTAGCTCTACTCCTTCTGGTGC TACTGGTTCTCCAGGTTCTAGCC CTTCTGCATCCACCGGTACCGG CCCAGGTTCTAGCCCGTCTGCTT CTACCGGTACTGGTCCAGGTGC TTCTCCGGGTACTAGCTCTACTG GTTCTCCAGGTGCATCTCCTGGT ACTAGCTCTACTGGTTCTCCAG GTAGCTCTACTCCGTCTGGTGC AACCGGCTCTCCAGGTTCTAGC CCTTCTGCATCTACCGGTACTG GTCCAGGTGCATCCCCTGGTAC CAGCTCTACCGGTTCTCCAGGT TCTAGCCCTTCTGCTTCTACCGG TACCGGTCCAGGTACCCCTGGC AGCGGTACCGCATCTTCCTCTC AGGTAGCTCTACTCCGTCTGG | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | TGCAACCGGTTCCCCAGGTAGC TCTACTCCTTCTGGTGCTACTGG CTCCCCAGGTGCATCCCCTGGC ACCAGCTCTACCGGTTCTCCA | |
| FIX-AM875 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGG TSTEPSEGSAPGSE PATSGSETPGSPAG SPTSTEEGSTSSTA ESPGPGTSTPESGS ASPGSTSESPSGTA PGSTSESPSGTAPG TSTPESGSASPGTS TPESGSASPGSEPA TSGSETPGTSESAT PESGPGSPAGSPTS TEEGTSTEPSEGSA PGTSESATPESGPG TSTEPSEGSAPGTS TEPSEGSAPGSPAG SPTSTEEGTSTEPS EGSAPGTSTEPSEG SAPGTSESATPESG PGTSESATPESGPG TSTEPSEGSAPGTS TEPSEGSAPGTSES ATPESGPGTSTEPS EGSAPGSEPATSGS ETPGSPAGSPTSTE EGSSTPSGATGSPG TPGSGTASSSPGSS TPSGATGSPGTSTE PSEGSAPGTSTEPS EGSAPGSEPATSGS ETPGSPAGSPTSTE EGSPAGSPTSTEEG TSTEPSEGSAPGAS ASGAPSTGGTSES ATPESGPGSPAGSP TSTEEGSPAGSPTS TEEGSTSSTAESPG PGSTSESPSGTAPG TSPSGESSTAPGTP GSGTASSSPGSSTP | 694 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGTGGTA CTTCTACTGAACCGTCTGAAGG CAGCGCACCAGGTAGCGAACCG GCTACTTCCGGTTCTGAAACCC CAGGTAGCCCAGCAGGTTCTCC AACTTCTACTGAAGAAGGTTCT ACCAGCTCTACCGCAGAATCTC CTGGTCCAGGTACCTCTACTCC GGAAAGCGGCTCTGCATCTCCA GGTTCTACTAGCGAATCTCCTTC TGGCACTGCACCAGGTTCTACT AGCGAATCCCCGTCTGGTACTG CTCCAGGTACTTCTACTCCTGA AAGCGGTTCCGCTTCTCCAGGT | 695 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | SGATGSPGSSPSAS | | ACCTCTACTCCGGAAAGCGGTT | |
| | TGTGPGSEPATSGS | | CTGCATCTCCAGGTAGCGAACC | |
| | ETPGTSESATPESG | | GGCAACCTCCGGCTCTGAAACC | |
| | PGSEPATSGSETPG | | CCAGGTACCTCTGAAAGCGCTA | |
| | STSSTAESPGPGST | | CTCCTGAATCCGGCCCAGGTAG | |
| | SSTAESPGPGTSPS | | CCCGGCAGGTTCTCCGACTTCC | |
| | GESSTAPGSEPATS | | ACTGAGGAAGGTACCTCTACTG | |
| | GSETPGSEPATSGS | | AACCTTCTGAGGGCAGCGCTCC | |
| | ETPGTSTEPSEGSA | | AGGTACTTCTGAAAGCGCTACC | |
| | PGSTSSTAESPGPG | | CCGGAGTCCGGTCCAGGTACTT | |
| | TSTPESGSASPGST | | CTACTGAACCGTCCGAAGGTAG | |
| | SESPSGTAPGTSTE | | CGCACCAGGTACTTCTACCGAA | |
| | PSEGSAPGTSTEPS | | CCGTCCGAGGGTAGCGCACCAG | |
| | EGSAPGTSTEPSEG | | GTAGCCCAGCAGGTTCTCCTAC | |
| | SAPGSSTPSGATGS | | CTCCACCGAGGAAGGTACTTCT | |
| | PGSSPSASTGTGPG | | ACCGAACCGTCCGAGGGTAGCG | |
| | ASPGTSSTGSPGSE | | CACCAGGTACTTCTACCGAACC | |
| | PATSGSETPGTSES | | TTCCGAGGGCAGCGCACCAGGT | |
| | ATPESGPGSPAGSP | | ACTTCTGAAAGCGCTACCCCTG | |
| | TSTEEGSSTPSGAT | | AGTCCGGCCCAGGTACTTCTGA | |
| | GSPGSSPSASTGTG | | AAGCGCTACTCCTGAATCCGGT | |
| | PGASPGTSSTGSPG | | CCAGGTACCTCTACTGAACCTT | |
| | TSESATPESGPGTS | | CCGAAGGCAGCGCTCCAGGTAC | |
| | TEPSEGSAPGTSTE | | CTCTACCGAACCGTCCGAGGGC | |
| | PSEGSAP | | AGCGCACCAGGTACTTCTGAAA | |
| | | | GCGCAACCCCTGAATCCGGTCC | |
| | | | AGGTACTTCTACTGAACCTTCC | |
| | | | GAAGGTAGCGCTCCAGGTAGCG | |
| | | | AACCTGCTACTTCTGGTTCTGA | |
| | | | AACCCCAGGTAGCCCGGCTGGC | |
| | | | TCTCCGACCTCCACCGAGGAAG | |
| | | | GTAGCTCTACCCCGTCTGGTGC | |
| | | | TACTGGTTCTCCAGGTACTCCG | |
| | | | GGCAGCGGTACTGCTTCTTCCT | |
| | | | CTCCAGGTAGCTCTACCCCTTCT | |
| | | | GGTGCTACTGGCTCTCCAGGTA | |
| | | | CCTCTACCGAACCGTCCGAGGG | |
| | | | TAGCGCACCAGGTACCTCTACT | |
| | | | GAACCGTCTGAGGGTAGCGCTC | |
| | | | CAGGTAGCGAACCGGCAACCTC | |
| | | | CGGTTCTGAAACTCCAGGTAGC | |
| | | | CCTGCTGGCTCTCCGACTTCTAC | |
| | | | TGAGGAAGGTAGCCCGGCTGGT | |
| | | | TCTCCGACTTCTACTGAGGAAG | |
| | | | GTACTTCTACCGAACCTTCCGA | |
| | | | AGGTAGCGCTCCAGGTGCAAGC | |
| | | | GCAAGCGGCGCGCCAAGCACG | |
| | | | GGAGGTACTTCTGAAAGCGCTA | |
| | | | CTCCTGAGTCCGGCCCAGGTAG | |
| | | | CCCGGCTGGCTCTCCGACTTCC | |
| | | | ACCGAGGAAGGTAGCCCGGCTG | |
| | | | GCTCTCCAACTTCTACTGAAGA | |
| | | | AGGTTCTACCAGCTCTACCGCT | |
| | | | GAATCTCCTGGCCCAGGTTCTA | |
| | | | CTAGCGAATCTCCGTCTGGCAC | |
| | | | CGCACCAGGTACTTCCCCTAGC | |
| | | | GGTGAATCTTCTACTGCACCAG | |
| | | | GTACCCCTGGCAGCGGTACCGC | |
| | | | TTCTTCCTCTCCAGGTAGCTCTA | |
| | | | CCCCGTCTGGTGCTACTGGCTCT | |
| | | | CCAGGTTCTAGCCCGTCTGCAT | |
| | | | CTACCGGTACCGGCCCAGGTAG | |
| | | | CGAACCGGCAACCTCCGGCTCT | |
| | | | GAAACTCCAGGTACTTCTGAAA | |
| | | | GCGCTACTCCGGAATCCGGCCC | |
| | | | AGGTAGCGAACCGGCTACTTCC | |
| | | | GGCTCTGAAACCCCAGGTTCCA | |
| | | | CCAGCTCTACTGCAGAATCTCC | |
| | | | GGGCCCAGGTTCTACTAGCTCT | |
| | | | ACTGCAGAATCTCCGGGTCCAG | |
| | | | GTACTTCTCCTAGCGGCGAATC | |
| | | | TTCTACCGCTCCAGGTAGCGAA | |
| | | | CCGGCAACCTCTGGCTCTGAAA | |
| | | | CTCCAGGTAGCGAACCTGCAAC | |
| | | | CTCCGGCTCTGAAACCCCAGGT | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | ACTTCTACTGAACCTTCTGAGG GCAGCGCACCAGGTTCTACCAG CTCTACCGCAGAATCTCCTGGT CCAGGTACCTCTACTCCGGAAA GCGGCTCTGCATCTCCAGGTTC TACTAGCGAATCTCCTTCTGGC ACTGCACCAGGTACTTCTACCG AACCGTCCGAAGGCAGCGCTCC AGGTACCTCTACTGAACCTTCC GAGGGCAGCGCTCCAGGTACCT CTACCGAACCTTCTGAAGGTAG CGCACCAGGTAGCTCTACTCCG TCTGGTGCAACCGGCTCCCCAG GTTCTAGCCCGTCTGCTTCCACT GGTACTGGCCCAGGTGCTTCCC CGGGCACCAGCTCTACTGGTTC TCCAGGTAGCGAACCTGCTACC TCCGGTTCTGAAACCCCAGGTA CCTCTGAAAGCGCAACTCCGGA GTCTGGTCCAGGTAGCCCTGCA GGTTCTCCTACCTCCACTGAGG AAGGTAGCTCTACTCCGTCTGG TGCAACCGGCTCCCCAGGTTCT AGCCCGTCTGCTTCCACTGGTA CTGGCCCAGGTGCTTCCCCGGG CACCAGCTCTACTGGTTCTCCA GGTACCTCTGAAAGCGCTACTC CGGAGTCTGGCCCAGGTACCTC TACTGAACCGTCTGAGGGTAGC GCTCCAGGTACTTCTACTGAAC CGTCCGAAGGTAGCGCACCA | | |
| FIX-AG864 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GPHEGGRDSCQGD SGGPHVTEVEGTS FLTGIISWGEECAM KGKYGIYTKVSRY VNWIKEKTKLTGG ASPGTSSTGSPGSS PSASTGTGPGSSPS ASTGTGPGTPGSG TASSSPGSSTPSGA TGSPGSNPSASTGT GPGASPGTSSTGSP GTPGSGTASSSPGS STPSGATGSPGTPG SGTASSSPGASPGT SSTGSPGASPGTSS TGSPGTPGSGTASS | 696 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA | 697 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | SPGSSTPSGATGSP | | AGGGAGATCAGCTTTAGTTCTT | |
| | GASPGTSSTGSPGT | | CAGTACCTTAGAGTTCCACTTG | |
| | PGSGTASSSPGSST | | TTGACCGAGCCACATGTCTTCG | |
| | PSGATGPGSNPSA | | ATCTACAAAGTTCACCATCTAT | |
| | STGTGPGSSPSAST | | AACAACATGTTCTGTGCTGGCT | |
| | GTGPGSSTPSGAT | | TCCATGAAGGAGGTAGAGATTC | |
| | GSPGSSTPSGATGS | | ATGTCAAGGAGATAGTGGGGG | |
| | PGASPGTSSTGSPG | | ACCCCATGTTACTGAAGTGGAA | |
| | ASPGTSSTGSPGAS | | GGGACCAGTTTCTTAACTGGAA | |
| | PGTSSTGSPGTPGS | | TTATTAGCTGGGGTGAAGAGTG | |
| | GTASSSPGASPGTS | | TGCAATGAAAGGCAAATATGGA | |
| | STGSPGASPGTSST | | ATATATACCAAGGTATCCCGGT | |
| | GSPGASPGTSSTGS | | ATGTCAACTGGATTAAGGAAAA | |
| | PGSSPSASTGTGPG | | AACAAAGCTCACTGGGGTGGTG | |
| | TPGSGTASSSPGAS | | CTTCCCCGGGCACCAGCTCTAC | |
| | PGTSSTGSPGASPG | | TGGTTCTCCAGGTTCTAGCCCGT | |
| | TSSTGSPGASPGTS | | CTGCTTCTACTGGTACTGGTCCA | |
| | STGSPGSSTPSGAT | | GGTTCTAGCCCTTCTGCTTCCAC | |
| | GSPGSSTPSGATGS | | TGGTACTGGTCCAGGTACCCCG | |
| | PGASPGTSSTGSPG | | GGTAGCGGTACCGCTTCTTCTTC | |
| | TPGSGTASSSPGSS | | TCCAGGTAGCTCTACTCCGTCT | |
| | TPSGATGSPGSSTP | | GGTGCTACCGGCTCTCCAGGTT | |
| | SGATGSPGSSTPSG | | CTAACCCTTCTGCATCCACCGG | |
| | ATGSPGSSPSASTG | | TACCGGCCCAGGTGCTTCTCCG | |
| | TGPGASPGTSSTGS | | GGCACCAGCTCTACTGGTTCTC | |
| | PGASPGTSSTGSPG | | CAGGTACCCCGGGCAGCGGTAC | |
| | TPGSGTASSSPGAS | | CGCATCTTCTTCTCCAGGTAGCT | |
| | PGTSSTGSPGASPG | | CTACTCCTTCTGGTGCAACTGGT | |
| | TSSTGSPGASPGTS | | TCTCCAGGTACTCCTGGCAGCG | |
| | STGSPGASPGTSST | | GTACCGCTTCTTCTTCTCCAGGT | |
| | GSPGTPGSGTASSS | | GCTTCTCCTGGTACTAGCTCTAC | |
| | PGSSTPSGATGSPG | | TGGTTCTCCAGGTGCTTCTCCGG | |
| | TPGSGTASSSPGSS | | GCACTAGCTCTACTGGTTCTCC | |
| | TPSGATGSPGTPGS | | AGGTACCCCGGGTAGCGGTACT | |
| | GTASSSPGSSTPSG | | GCTTCTTCCTCTCCAGGTAGCTC | |
| | ATGSPGSSTPSGAT | | TACCCCTTCTGGTGCAACCGGC | |
| | GSPGSSPSASTGTG | | TCTCCAGGTGCTTCTCCGGGCA | |
| | PGSSPSASTGTGPG | | CCAGCTCTACCGGTTCTCCAGG | |
| | ASPGTSSTGSPGTP | | TACCCCGGGTAGCGGTACCGCT | |
| | GSGTASSSPGSSTP | | TCTTCTTCTCCAGGTAGCTCTAC | |
| | SGATGSPGSSPSAS | | TCCGTCTGGTGCTACCGGCTCTC | |
| | TGTGPGSSPSASTG | | CAGGTTCTAACCCTTCTGCATCC | |
| | TGPGASPGTSSTGS | | ACCGGTACCGGCCCAGGTTCTA | |
| | PGASPGTSSTGSPG | | GCCCTTCTGCTTCCACCGGTACT | |
| | SSTPSGATGSPGSS | | GGCCCAGGTAGCTCTACCCCTT | |
| | PSASTGTGPGASPG | | CTGGTGCTACCGGCTCCCCAGG | |
| | TSSTGSPGSSPSAS | | TAGCTCTACTCCTTCTGGTGCAA | |
| | TGTGPGTPGSGTA | | CTGGCTCTCCAGGTGCATCTCC | |
| | SSSPGSSTPSGATG | | GGGCACTAGCTCTACTGGTTCT | |
| | SPGSSTPSGATGSP | | CCAGGTGCATCCCTGGCACTA | |
| | GASPGTSSTGSP | | GCTCTACTGGTTCTCCAGGTGCT | |
| | | | TCTCCTGGTACCAGCTCTACTG | |
| | | | GTTCTCCAGGTACTCCTGGCAG | |
| | | | CGGTACCGCTTCTTCTTCTCCAG | |
| | | | GTGCTTCTCCTGGTACTAGCTCT | |
| | | | ACTGGTTCTCCAGGTGCTTCTCC | |
| | | | GGGCACTAGCTCTACTGGTTCT | |
| | | | CCAGGTGCTTCCCCGGGCACTA | |
| | | | GCTCTACCGGTTCTCCAGGTTCT | |
| | | | AGCCCTTCTGCATCTACTGGTA | |
| | | | CTGGCCCAGGTACTCCGGGCAG | |
| | | | CGGTACTGCTTCTTCCTCTCCAG | |
| | | | GTGCATCTCCGGGCACTAGCTC | |
| | | | TACTGGTTCTCCAGGTGCATCC | |
| | | | CCTGGCACTAGCTCTACTGGTT | |
| | | | CTCCAGGTGCTTCTCCTGGTACC | |
| | | | AGCTCTACTGGTTCTCCAGGTA | |
| | | | GCTCTACTCCGTCTGGTGCAAC | |
| | | | CGGTTCCCCAGGTAGCTCTACT | |
| | | | CCTTCTGGTGCTACTGGCTCCCC | |
| | | | AGGTGCATCCCTGGCACCAGC | |
| | | | TCTACCGGTTCTCCAGGTACCC | |
| | | | CGGGCAGCGGTACCGCATCTTC | |
| | | | CTCTCCAGGTAGCTCTACCCCG | |
| | | | TCTGGTGCTACCGGTTCCCCAG | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | GTAGCTCTACCCCGTCTGGTGC AACCGGCTCCCCAGGTAGCTCT ACTCCGTCTGGTGCAACCGGCT CCCCAGGTTCTAGCCCGTCTGC TTCCACTGGTACTGGCCCAGGT GCTTCCCCGGGCACCAGCTCTA CTGGTTCTCCAGGTGCATCCCC GGGTACCAGCTCTACCGGTTCT CCAGGTACTCCTGGCAGCGGTA CTGCATCTTCCTCTCCAGGTGCT TCTCCGGGCACCAGCTCTACTG GTTCTCCAGGTGCATCTCCGGG CACTAGCTCTACTGGTTCTCCA GGTGCATCCCCTGGCACTAGCT CTACTGGTTCTCCAGGTGCTTCT CCTGGTACCAGCTCTACTGGTT CTCCAGGTACCCCTGGTAGCGG TACTGCTTCTTCCTCTCCAGGTA GCTCTACTCCGTCTGGTGCTACC GGTTCTCCAGGTACCCCGGGTA GCGGTACCGCATCTTCTTCTCCA GGTAGCTCTACCCCGTCTGGTG CTACTGGTTCTCCAGGTACTCC GGGCAGCGGTACTGCTTCTTCC TCTCCAGGTAGCTCTACCCCTTC TGGTGCTACTGGCTCTCCAGGT AGCTCTACCCCGTCTGGTGCTA CTGGCTCCCCAGGTTCTAGCCC TTCTGCATCCACCGGTACCGGT CCAGGTTCTAGCCCGTCTGCAT CTACTGGTACTGGTCCAGGTGC ATCCCCGGGCACTAGCTCTACC GGTTCTCCAGGTACTCCTGGTA GCGGTACTGCTTCTTCTTCTCCA GGTAGCTCTACTCCTTCTGGTGC TACTGGTTCTCCAGGTTCTAGCC CTTCTGCATCCACCGGTACCGG CCCAGGTTCTAGCCCGTCTGCTT CTACCGGTACTGGTCCAGGTGC TTCTCCGGGTACTAGCTCTACTG GTTCTCCAGGTGCATCTCCTGGT ACTAGCTCTACTGGTTCTCCAG GTAGCTCTACTCCGTCTGGTGC AACCGGCTCTCCAGGTTCTAGC CCTTCTGCATCTACCGGTACTG GTCCAGGTGCATCCCCTGGTAC CAGCTCTACCGGTTCTCCAGGT TCTAGCCCTTCTGCTTCTACCGG TACCGGTCCAGGTACCCCTGGC AGCGGTACCGCATCTTCCTCTC CAGGTAGCTCTACTCCGTCTGG TGCAACCGGTTCCCCAGGTAGC TCTACTCCTTCTGGTGCTACTGG CTCCCCAGGTGCATCCCCTGGC ACCAGCTCTACCGGTTCTCCA | |
| FIX- AM875 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE | 698 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAAGAGTTTCTGTTTCACAAA | 699 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | QKRNVIRIIPHHNY | | CTTCTAAGCTCACCCGTGCTGA | |
| | NAAINKYNHDIAL | | GACTGTTTTCCTGATGTGGACT | |
| | LELDEPLVLNSYV | | ATGTAAATTCTACTGAAGCTGA | |
| | TPICIADKEYTNIFL | | AACCATTTTGGATAACATCACT | |
| | KFGSGYVSGWGR | | CAAAGCACCCAATCATTTAATG | |
| | VFHKGRSALVLQY | | ACTTCACTCGGGTTGTTGGTGG | |
| | LRVPLVDRATCLR | | AGAAGATGCCAAACCAGGTCA | |
| | STKFTIYNNMFCA | | ATTCCCTTGGCAGGTTGTTTTGA | |
| | GFHEGGRDSCQGD | | ATGGTAAAGTTGATGCATTCTG | |
| | SGGPHVTEVEGTS | | TGGAGGCTCTATCGTTAATGAA | |
| | FLTGIISWGEECAM | | AAATGGATTGTAACTGCTGCCC | |
| | KGKYGIYTKVSRY | | ACTGTGTTGAAACTGGTGTTAA | |
| | VNWIKEKTKLTGG | | AATTACAGTTGTCGCAGGTGAA | |
| | TSTEPSEGSAPGSE | | CATAATATTGAGGAGACAGAAC | |
| | PATSGSETPGSPAG | | ATACAGAGCAAAAGCGAAATG | |
| | SPTSTEEGSTSSTA | | TGATTCGAATTATTCCTCACCAC | |
| | ESPGPGTSTPESGS | | AACTACAATGCAGCTATTAATA | |
| | ASPGSTSESPSGTA | | AGTACAACCATGACATTGCCCT | |
| | PGSTSESPSGTAPG | | TCTGGAACTGGACGAACCCTTA | |
| | TSTPESGSASPGTS | | GTGCTAAACAGCTACGTTACAC | |
| | TPESGSASPGSEPA | | CTATTTGCATTGCTGACAAGGA | |
| | TSGSETPGTSESAT | | ATACACGAACATCTTCCTCAAA | |
| | PESGPGSPAGSPTS | | TTTGGATCTGGCTATGTAAGTG | |
| | TEEGTSTEPSEGSA | | GCTGGGGAAGAGTCTTCCACAA | |
| | PGTSESATPESGPG | | AGGGAGATCAGCTTTAGTTCTT | |
| | TSTEPSEGSAPGTS | | CAGTACCTTAGAGTTCCACTTG | |
| | TEPSEGSAPGSPAG | | TTGACCGAGCCACATGTCTTCG | |
| | SPTSTEEGTSTEPS | | ATCTACAAAGTTCACCATCTAT | |
| | EGSAPGTSTEPSEG | | AACAACATGTTCTGTGCTGGCT | |
| | SAPGTSESATPESG | | TCCATGAAGGAGGTAGAGATTC | |
| | PGTSESATPESGPG | | ATGTCAAGGAGATAGTGGGGG | |
| | TSTEPSEGSAPGTS | | ACCCCATGTTACTGAAGTGGAA | |
| | TEPSEGSAPGTSES | | GGGACCAGTTTCTTAACTGGAA | |
| | ATPESGPGTSTEPS | | TTATTAGCTGGGGTGAAGAGTG | |
| | EGSAPGSEPATSGS | | TGCAATGAAAGGCAAATATGGA | |
| | ETPGSPAGSPTSTE | | ATATATACCAAGGTATCCCGGT | |
| | EGSSTPSGATGSPG | | ATGTCAACTGGATTAAGGAAAA | |
| | TPGSGTASSSPGSS | | AACAAAGCTCACTGGGGTGGTA | |
| | TPSGATGSPGTSTE | | CTTCTACTGAACCGTCTGAAGG | |
| | PSEGSAPGTSTEPS | | CAGCGCACCAGGTAGCGAACCG | |
| | EGSAPGSEPATSGS | | GCTACTTCCGGTTCTGAAACCC | |
| | ETPGSPAGSPTSTE | | CAGGTAGCCCAGCAGGTTCTCC | |
| | EGSPAGSPTSTEEG | | AACTTCTACTGAAGAAGGTTCT | |
| | TSTEPSEGSAPGAS | | ACCAGCTCTACCGCAGAATCTC | |
| | ASGAPSTGGTSES | | CTGGTCCAGGTACCTCTACTCC | |
| | ATPESGPGSPAGSP | | GGAAAGCGGCTCTGCATCTCCA | |
| | TSTEEGSPAGSPTS | | GGTTCTACTAGCGAATCTCCTTC | |
| | TEEGSTSSTAESPG | | TGGCACTGCACCAGGTTCTACT | |
| | PGSTSESPSGTAPG | | AGCGAATCCCCGTCTGGTACTG | |
| | TSPSGESSTAPGTP | | CTCCAGGTACTTCTACTCCTGA | |
| | GSGTASSSPGSSTP | | AAGCGGTTCCGCTTCTCCAGGT | |
| | SGATGSPGSSPSAS | | ACCTCTACTCCGGAAAGCGGTT | |
| | TGTGPGSEPATSGS | | CTGCATCTCCAGGTAGCGAACC | |
| | ETPGTSESATPESG | | GGCAACCTCCGGCTCTGAAACC | |
| | PGSEPATSGSETPG | | CCAGGTACCTCTGAAAGCGCTA | |
| | STSSTAESPGPGST | | CTCCTGAATCCGGCCCAGGTAG | |
| | SSTAESPGPGTSPS | | CCCGGCAGGTTCTCCGACTTCC | |
| | GESSTAPGSEPATS | | ACTGAGGAAGGTACCTCTACTG | |
| | GSETPGSEPATSGS | | AACCTTCTGAGGGCAGCGCTCC | |
| | ETPGTSTEPSEGSA | | AGGTACTTCTGAAAGCGCTACC | |
| | PGSTSSTAESPGPG | | CCGGAGTCCGGTCCAGGTACTT | |
| | TSTPESGSASPGST | | CTACTGAACCGTCCGAAGGTAG | |
| | SESPSGTAPGTSTE | | CGCACCAGGTACTTCTACCGAA | |
| | PSEGSAPGTSTEPS | | CCGTCCGAGGGTAGCGCACCAG | |
| | EGSAPGTSTEPSEG | | GTAGCCCAGCAGGTTCTCCTAC | |
| | SAPGSSTPSGATGS | | CTCCACCGAGGAAGGTACTTCT | |
| | PGSSPSASTGTGPG | | ACCGAACCGTCCGAGGGTAGCG | |
| | ASPGTSSTGSPGSE | | CACCAGGTACTTCTACCGAACC | |
| | PATSGSETPGTSES | | TTCCGAGGGCAGCGCACCAGGT | |
| | ATPESGPGSPAGSP | | ACTTCTGAAAGCGCTACCCCTG | |
| | TSTEEGSSTPSGAT | | AGTCCGGCCCAGGTACTTCTGA | |
| | GSPGSSPSASTGTG | | AAGCGCTACTCCTGAATCCGGT | |
| | PGASPGTSSTGSPG | | CCAGGTACCTCTACTGAACCTT | |
| | TSESATPESGPGTS | | CCGAAGGCAGCGCTCCAGGTAC | |
| | TEPSEGSAPGTSTE | | CTCTACCGAACCGTCCGAGGGC | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | PSEGSAP | | AGCGCACCAGGTACTTCTGAAA | |
| | | | GCGCAACCCCTGAATCCGGTCC | |
| | | | AGGTACTTCTACTGAACCTTCC | |
| | | | GAAGGTAGCGCTCCAGGTAGCG | |
| | | | AACCTGCTACTTCTGGTTCTGA | |
| | | | AACCCCAGGTAGCCCGGCTGGC | |
| | | | TCTCCGACCTCCACCGAGGAAG | |
| | | | GTAGCTCTACCCCGTCTGGTGC | |
| | | | TACTGGTTCTCCAGGTACTCCG | |
| | | | GGCAGCGGTACTGCTTCTTCCT | |
| | | | CTCCAGGTAGCTCTACCCCTTCT | |
| | | | GGTGCTACTGGCTCTCCAGGTA | |
| | | | CCTCTACCGAACCGTCCGAGGG | |
| | | | TAGCGCACCAGGTACCTCTACT | |
| | | | GAACCGTCTGAGGGTAGCGCTC | |
| | | | CAGGTAGCGAACCGGCAACCTC | |
| | | | CGGTTCTGAAACTCCAGGTAGC | |
| | | | CCTGCTGGCTCTCCGACTTCTAC | |
| | | | TGAGGAAGGTAGCCCGGCTGGT | |
| | | | TCTCCGACTTCTACTGAGGAAG | |
| | | | GTACTTCTACCGAACCTTCCGA | |
| | | | AGGTAGCGCTCCAGGTGCAAGC | |
| | | | GCAAGCGGCGCGCCAAGCACG | |
| | | | GGAGGTACTTCTGAAAGCGCTA | |
| | | | CTCCTGAGTCCGGCCCAGGTAG | |
| | | | CCCGGCTGGCTCTCCGACTTCC | |
| | | | ACCGAGGAAGGTAGCCCGGCTG | |
| | | | GCTCTCCAACTTCTACTGAAGA | |
| | | | AGGTTCTACCAGCTCTACCGCT | |
| | | | GAATCTCCTGGCCCAGGTTCTA | |
| | | | CTAGCGAATCTCCGTCTGGCAC | |
| | | | CGCACCAGGTACTTCCCCTAGC | |
| | | | GGTGAATCTTCTACTGCACCAG | |
| | | | GTACCCCTGGCAGCGGTACCGC | |
| | | | TTCTTCCTCTCCAGGTAGCTCTA | |
| | | | CCCCGTCTGGTGCTACTGGCTCT | |
| | | | CCAGGTTCTAGCCCGTCTGCAT | |
| | | | CTACCGGTACCGGCCCAGGTAG | |
| | | | CGAACCGGCAACCTCCGGCTCT | |
| | | | GAAACTCCAGGTACTTCTGAAA | |
| | | | GCGCTACTCCGGAATCCGGCCC | |
| | | | AGGTAGCGAACCGGCTACTTCC | |
| | | | GGCTCTGAAACCCCAGGTTCCA | |
| | | | CCAGCTCTACTGCAGAATCTCC | |
| | | | GGGCCCAGGTTCTACTAGCTCT | |
| | | | ACTGCAGAATCTCCGGGTCCAG | |
| | | | GTACTTCTCCTAGCGGCGAATC | |
| | | | TTCTACCGCTCCAGGTAGCGAA | |
| | | | CCGGCAACCTCTGGCTCTGAAA | |
| | | | CTCCAGGTAGCGAACCTGCAAC | |
| | | | CTCCGGCTCTGAAACCCCAGGT | |
| | | | ACTTCTACTGAACCTTCTGAGG | |
| | | | GCAGCGCACCAGGTTCTACCAG | |
| | | | CTCTACCGCAGAATCTCCTGGT | |
| | | | CCAGGTACCTCTACTCCGGAAA | |
| | | | GCGGCTCTGCATCTCCAGGTTC | |
| | | | TACTAGCGAATCTCCTTCTGGC | |
| | | | ACTGCACCAGGTACTTCTACCG | |
| | | | AACCGTCCGAAGGCAGCGCTCC | |
| | | | AGGTACCTCTACTGAACCTTCC | |
| | | | GAGGGCAGCGCTCCAGGTACCT | |
| | | | CTACCGAACCTTCTGAAGGTAG | |
| | | | CGCACCAGGTAGCTCTACTCCG | |
| | | | TCTGGTGCAACCGGCTCCCCAG | |
| | | | GTTCTAGCCCGTCTGCTTCCACT | |
| | | | GGTACTGGCCCAGGTGCTTCCC | |
| | | | CGGGCACCAGCTCTACTGGTTC | |
| | | | TCCAGGTAGCGAACCTGCTACC | |
| | | | TCCGGTTCTGAAACCCCAGGTA | |
| | | | CCTCTGAAAGCGCAACTCCGGA | |
| | | | GTCTGGTCCAGGTAGCCCTGCA | |
| | | | GGTTCTCCTACCTCCACTGAGG | |
| | | | AAGGTAGCTCTACTCCGTCTGG | |
| | | | TGCAACCGGCTCCCCAGGTTCT | |
| | | | AGCCCGTCTGCTTCCACTGGTA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | CTGGCCCAGGTGCTTCCCCGGG CACCAGCTCTACTGGTTCTCCA GGTACCTCTGAAAGCGCTACTC CGGAGTCTGGCCCAGGTACCTC TACTGAACCGTCTGAGGGTAGC GCTCCAGGTACTTCTACTGAAC CGTCCGAAGGTAGCGCACCA | |
| FIX-AM1318 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGG TSTEPSEGSAPGSE PATSGSETPGSPAG SPTSTEEGSTSSTA ESPGPGTSTPESGS ASPGSTSESPSGTA PGSTSESPSGTAPG TSTPESGSASPGTS TPESGSASPGSEPA TSGSETPGTSESAT PESGPGSPAGSPTS TEEGTSTEPSEGSA PGTSESATPESGPG TSTEPSEGSAPGTS TEPSEGSAPGSPAG SPTSTEEGTSTEPS EGSAPGTSTEPSEG SAPGTSESATPESG PGTSESATPESGPG TSTEPSEGSAPGTS TEPSEGSAPGTSES ATPESGPGTSTEPS EGSAPGSEPATSGS ETPGSPAGSPTSTE EGSSTPSGATGSPG TPGSGTASSSPGSS TPSGATGSPGTSTE PSEGSAPGTSTEPS EGSAPGSEPATSGS ETPGSPAGSPTSTE EGSPAGSPTSTEEG TSTEPSEGSAPGPE PTGPAPSGGSEPAT SGSETPGTSESATP ESGPGSPAGSPTST EEGTSESATPESGP | 700 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGTGGTA CTTCTACTGAACCGTCTGAGG CAGCGCACCAGGTAGCGAACCG GCTACTTCCGGTTCTGAAACCC CAGGTAGCCCAGCAGGTTCTCC AACTTCTACTGAAGAAGGTTCT ACCAGCTCTACCGCAGAATCTC CTGGTCCAGGTACCTCTACTCC GGAAAGCGGCTCTGCATCTCCA GGTTCTACTAGCGAATCTCCTTC TGGCACTGCACCAGGTTCTACT | 701 |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | GSPAGSPTSTEEGS | | AGCGAATCCCCGTCTGGTACTG | |
| | PAGSPTSTEEGTSE | | CTCCAGGTACTTCTACTCCTGA | |
| | SATPESGPGSPAGS | | AAGCGGTTCCGCTTCTCCAGGT | |
| | PTSTEEGSPAGSPT | | ACCTCTACTCCGGAAAGCGGTT | |
| | STEEGSTSSTAESP | | CTGCATCTCCAGGTAGCGAACC | |
| | GPGSTSESPSGTAP | | GGCAACCTCCGGCTCTGAAACC | |
| | GTSPSGESSTAPGS | | CCAGGTACCTCTGAAAGCGCTA | |
| | TSESPSGTAPGSTS | | CTCCTGAATCCGGCCCAGGTAG | |
| | ESPSGTAPGTSPSG | | CCCCGGCAGGTTCTCCGACTTCC | |
| | ESSTAPGTSTEPSE | | ACTGAGGAAGGTACCTCTACTG | |
| | GSAPGTSESATPES | | AACCTTCTGAGGGCAGCGCTCC | |
| | GPGTSESATPESGP | | AGGTACTTCTGAAAGCGCTACC | |
| | GSEPATSGSETPGT | | CCGGAGTCCGGTCCAGGTACTT | |
| | SESATPESGPGTSE | | CTACTGAACCGTCCGAAGGTAG | |
| | SATPESGPGTSTEP | | CGCACCAGGTACTTCTACCGAA | |
| | SEGSAPGTSESATP | | CCGTCCGAGGGTAGCGCACCAG | |
| | ESGPGTSTEPSEGS | | GTAGCCCAGCAGGTTCTCCTAC | |
| | APGTSPSGESSTAP | | CTCCACCGAGGAAGGTACTTCT | |
| | GTSPSGESSTAPGT | | ACCGAACCGTCCGAGGGTAGCG | |
| | SPSGESSTAPGTST | | CACCAGGTACTTCTACCGAACC | |
| | EPSEGSAPGSPAGS | | TTCCGAGGGCAGCGCACCAGGT | |
| | PTSTEEGTSTEPSE | | ACTTCTGAAAGCGCTACCCCTG | |
| | GSAPGSSPSASTGT | | AGTCCGGCCCAGGTACTTCTGA | |
| | GPGSSTPSGATGSP | | AAGCGCTACTCCTGAATCCGGT | |
| | GSSTPSGATGSPGS | | CCAGGTACCTCTACTGAACCTT | |
| | STPSGATGSPGSST | | CCGAAGGCAGCGCTCCAGGTAC | |
| | PSGATGSPGASPGT | | CTCTACCGAACCGTCCGAGGGC | |
| | SSTGSPGASASGAP | | AGCGCACCAGGTACTTCTGAAA | |
| | STGGTSPSGESSTA | | GCGCAACCCCTGAATCCGGTCC | |
| | PGSTSSTAESPGPG | | AGGTACTTCTACTGAACCTTCC | |
| | TSPSGESSTAPGTS | | GAAGGTAGCGCTCCAGGTAGCG | |
| | ESATPESGPGTSTE | | AACCTGCTACTTCTGGTTCTGA | |
| | PSEGSAPGTSTEPS | | AACCCCAGGTAGCCCGGCTGGC | |
| | EGSAPGSSPSASTG | | TCTCCGACCTCCACCGAGGAAG | |
| | TGPGSSTPSGATGS | | GTAGCTCTACCCCGTCTGGTGC | |
| | PGASPGTSSTGSPG | | TACTGGTTCTCCAGGTACTCCG | |
| | TSTPESGSASPGTS | | GGCAGCGGTACTGCTTCTTCCT | |
| | PSGESSTAPGTSPS | | CTCCAGGTAGCTCTACCCCTTCT | |
| | GESSTAPGTSESAT | | GGTGCTACTGGCTCTCCAGGTA | |
| | PESGPGSEPATSGS | | CCTCTACCGAACCGTCCGAGGG | |
| | ETPGTSTEPSEGSA | | TAGCGCACCAGGTACCTCTACT | |
| | PGSTSESPSGTAPG | | GAACCGTCTGAGGGTAGCGCTC | |
| | STSESPSGTAPGTS | | CAGGTAGCGAACCGGCAACCTC | |
| | TPESGSASPGSPAG | | CGGTTCTGAAACTCCAGGTAGC | |
| | SPTSTEEGTSESAT | | CCTGCTGGCTCTCCGACTTCTAC | |
| | PESGPGTSTEPSEG | | TGAGGAAGGTAGCCCGGCTGGT | |
| | SAPGSPAGSPTSTE | | TCTCCGACTTCTACTGAGGAAG | |
| | EGTSESATPESGPG | | GTACTTCTACCGAACCTTCCGA | |
| | SEPATSGSETPGSS | | AGGTAGCGCTCCAGGTCCAGAA | |
| | TPSGATGSPGASPG | | CCAACGGGCCGGCCCCAAGCG | |
| | TSSTGSPGSSTPSG | | GAGGTAGCGAACCGGCAACCTC | |
| | ATGSPGSTSESPSG | | CGGCTCTGAAACCCCAGGTACC | |
| | TAPGTSPSGESSTA | | TCTGAAAGCGCTACTCCTGAAT | |
| | PGSTSSTAESPGPG | | CCGGCCCAGGTAGCCCGGCAGG | |
| | SSTPSGATGSPGAS | | TTCTCCGACTTCCACTGAGGAA | |
| | PGTSSTGSPGTPGS | | GGTACTTCTGAAAGCGCTACTC | |
| | GTASSSPGSPAGSP | | CTGAGTCCGGCCCAGGTAGCCC | |
| | TSTEEGSPAGSPTS | | GGCTGGCTCTCCGACTTCCACC | |
| | TEEGTSTEPSEGSAP | | GAGGAAGGTAGCCCGGCTGGCT | |
| | | | CTCCAACTTCTACTGAAGAAGG | |
| | | | TACTTCTGAAAGCGCTACTCCT | |
| | | | GAGTCCGGCCCAGGTAGCCCGG | |
| | | | CTGGCTCTCCGACTTCCACCGA | |
| | | | GGAAGGTAGCCCGGCTGGCTCT | |
| | | | CCAACTTCTACTGAAGAAGGTT | |
| | | | CTACCAGCTCTACCGCTGAATC | |
| | | | TCCTGGCCCAGGTTCTACTAGC | |
| | | | GAATCTCCGTCTGGCACCGCAC | |
| | | | CAGGTACTTCCCCTAGCGGTGA | |
| | | | ATCTTCTACTGCACCAGGTTCTA | |
| | | | CCAGCGAATCTCCTTCTGGCAC | |
| | | | CGCTCCAGGTTCTACTAGCGAA | |
| | | | TCCCCGTCTGGTACCGCACCAG | |
| | | | GTACTTCTCCTAGCGGCGAATC | |
| | | | TTCTACCGCACCAGGTACTTCT | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | ACCGAACCTTCCGAGGGCAGCG CACCAGGTACTTCTGAAAGCGC TACCCCTGAGTCCGGCCCAGGT ACTTCTGAAAGCGCTACTCCTG AATCCGGTCCAGGTAGCGAACC GGCAACCTCTGGCTCTGAAACC CCAGGTACCTCTGAAAGCGCTA CTCCGGAATCTGGTCCAGGTAC TTCTGAAAGCGCTACTCCGGAA TCCGGTCCAGGTACCTCTACTG AACCTTCTGAGGGCAGCGCTCC AGGTACTTCTGAAAGCGCTACC CCGGAGTCCGGTCCAGGTACTT CTACTGAACCGTCCGAAGGTAG CGCACCAGGTACCTCCCCTAGC GGCGAATCTTCTACTGCTCCAG GTACCTCTCCTAGCGGCGAATC TTCTACCGCTCCAGGTACCTCC CTAGCGGTGAATCTTCTACCGC ACCAGGTACTTCTACCGAACCG TCCGAGGGTAGCGCACCAGGTA GCCCAGCAGGTTCTCCTACCTC CACCGAGGAAGGTACTTCTACC GAACCGTCCGAGGGTAGCGCAC CAGGTTCTAGCCCTTCTGCTTCC ACCGGTACCGGCCCAGGTAGCT CTACTCCGTCTGGTGCAACTGG CTCTCCAGGTAGCTCTACTCCGT CTGGTGCAACCGGCTCCCCAGG TAGCTCTACCCCGTCTGGTGCT ACCGGCTCTCCAGGTAGCTCTA CCCCGTCTGGTGCAACCGGCTC CCCAGGTGCATCCCCGGGTACT AGCTCTACCGGTTCTCCAGGTG CAAGCGCAAGCGGCGCGCCAA GCACGGGAGGTACTTCTCCGAG CGGTGAATCTTCTACCGCACCA GGTTCTACTAGCTCTACCGCTG AATCTCCGGGCCCAGGTACTTC TCCGAGCGGTGAATCTTCTACT GCTCCAGGTACCTCTGAAAGCG CTACTCCGGAGTCTGGCCCAGG TACCTCTACTGAACCGTCTGAG GGTAGCGCTCCAGGTACTTCTA CTGAACCGTCCGAAGGTAGCGC ACCAGGTTCTAGCCCTTCTGCA TCTACTGGTACTGGCCCAGGTA GCTCTACTCCTTCTGGTGCTACC GGCTCTCCAGGTGCTTCTCCGG GTACTAGCTCTACCGGTTCTCC AGGTACTTCTACTCCGGAAAGC GGTTCCGCATCTCCAGGTACTT CTCCTAGCGGTGAATCTTCTACT GCTCCAGGTACCTCTCCTAGCG GCGAATCTTCTACTGCTCCAGG TACTTCTGAAAGCGCAACCCCT GAATCCGGTCCAGGTAGCGAAC CGGCTACTTCTGGCTCTGAGAC TCCAGGTACTTCTACCGAACCG TCCGAAGGTAGCGCACCAGGTT CTACCAGCGAATCCCCTTCTGG TACTGCTCCAGGTTCTACCAGC GAATCCCCTTCTGGCACCGCAC CAGGTACTTCTACCCCTGAAAG CGGCTCCGCTTCTCCAGGTAGC CCGGCAGGCTCTCCGACCTCTA CTGAGGAAGGTACTTCTGAAAG CGCAACCCCGGAGTCCGGCCCA GGTACCTCTACCGAACCGTCTG AGGGCAGCGCACCAGGTAGCC TGCTGGCTCTCCAACCTCCACC GAAGAAGGTACCTCTGAAAGCG CAACCCCTGAATCCGGCCCAGG TAGCGAACCGGCAACCTCCGGT TCTGAAACCCCAGGTAGCTCTA | |

TABLE 41-continued

Exemplary CFXTEN comprising CF and single XTEN

| CFXTEN Name* | Amino Acid Sequence | SEQ ID NO: | DNA Nucleotide Sequence | SEQ ID NO: |
|---|---|---|---|---|
| | | | CCCCGTCTGGTGCTACCGGTTC | |
| | | | CCCAGGTGCTTCTCCTGGTACT | |
| | | | AGCTCTACCGGTTCTCCAGGTA | |
| | | | GCTCTACCCCGTCTGGTGCTACT | |
| | | | GGCTCTCCAGGTTCTACTAGCG | |
| | | | AATCCCCGTCTGGTACTGCTCC | |
| | | | AGGTACTTCCCCTAGCGGTGAA | |
| | | | TCTTCTACTGCTCCAGGTTCTAC | |
| | | | CAGCTCTACCGCAGAATCTCCG | |
| | | | GGTCCAGGTAGCTCTACCCCTT | |
| | | | CTGGTGCAACCGGCTCTCCAGG | |
| | | | TGCATCCCCGGGTACCAGCTCT | |
| | | | ACCGGTTCTCCAGGTACTCCGG | |
| | | | GTAGCGGTACCGCTTCTTCCTCT | |
| | | | CCAGGTAGCCCTGCTGGCTCTC | |
| | | | CGACTTCTACTGAGGAAGGTAG | |
| | | | CCCGGCTGGTTCTCCGACTTCTA | |
| | | | CTGAGGAAGGTACTTCTACCGA | |
| | | | ACCTTCCGAAGGTAGCGCTCCA | |

*Sequence name reflects N- to C-terminus configuration of the coagulation factor and XTEN components

TABLE 42

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| FVII-FXIa-AE288 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG KLTRAETGGTSES ATPESGPGSEPATS GSETPGTSESATPE SGPGSEPATSGSET PGTSESATPESGPG TSTEPSEGSAPGSP AGSPTSTEEGTSES ATPESGPGSEPATS GSETPGTSESATPE SGPGSPAGSPTSTE EGSPAGSPTSTEEG | 702 | GCCAACGCGTTCCTGGAGGAGC TACGGCCGGGCTCCCTGGAGAG GGAGTGCAAGGAGGAGCAGTG CTCCTTCGAGGAGGCCCGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC | 703 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | TSTEPSEGSAPGTS ESATPESGPGTSES ATPESGPGTSESAT PESGPGSEPATSGS ETPGSEPATSGSET PGSPAGSPTSTEEG TSTEPSEGSAPGTS TEPSEGSAPGSEPA TSGSETPGTSESAT PESGPGTSTEPSEG SAP | | CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGT0GGTGGT ACCTCTGAAAGCGCAACTCCTG AGTCTGGCCCAGGTAGCGAACC TGCTACCTCCGGCTCTGAGACT CCAGGTACCTCTGAAAGCGCAA CCCCGGAATCTGGTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCAGGTAGC CCTGCTGGCTCTCCAACCTCCA CCGAAGAAGGTACCTCTGAAAG CGCAACCCCTGAATCCGGCCCA GGTAGCGAACCGGCAACCTCCG GTTCTGAAACCCCAGGTACTTC TGAAAGCGCTACTCCTGAGTCC GGCCCAGGTAGCCCGGCTGGCT CTCCGACTTCCACCGAGGAAGG TAGCCCGGCTGGCTCTCCAACT TCTACTGAAGAAGGTACTTCTA CCGAACCTTCCGAGGGCAGCGC ACCAGGTACTTCTGAAAGCGCT ACCCCTGAGTCCGGCCCAGGTA CTTCTGAAAGCGCTACTCCTGA ATCGGTCCAGGTACTTCTGAA AGCGCTACCCCGGAATCTGGCC CAGGTAGCGAACCGGCTACTTC TGGTTCTGAAACCCCAGGTAGC GAACCGGCTACCTCCGGTTCTG AAACTCCAGGTAGCCCAGCAGG CTCTCCGACTTCCACTGAGGAA GGTACTTCTACTGAACCTTCCG AAGGCAGCGCACCAGGTACCTC TACTGAACCTTCTGAGGGCAGC GCTCCAGGTAGCGAACCTGCAA CCTCTGGCTCTGAAACCCCAGG TACCTCTGAAAGCGCTACTCCT GAATCTGGCCCAGGTACTTCTA CTGAACCGTCCGAGGGCAGCGC ACCA | |
| FVII-FXIa-AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT | 704 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA | 705 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | NHDIALLRLHQPV | | TATCCATGTGGAAAAATACCTA | |
| | VLTDHVVPLCLPE | | TTCTAGAAAAAAGAAATGCCAG | |
| | RTFSERTLAFVRFS | | CAAACCCCAAGGCCGAATTGTG | |
| | LVSGWGQLLDRG | | GGGGGCAAGGTGTGCCCCAAA | |
| | ATALELMVLNVPR | | GGGGAGTGTCCATGGCAGGTCC | |
| | LMTQDCLQQSRK | | TGTTGTTGGTGAATGGAGCTCA | |
| | VGDSPNITEYMFC | | GTTGTGTGGGGGGACCCTGATC | |
| | AGYSDGSKDSCKG | | AACACCATCTGGGTGGTCTCCG | |
| | DSGGPHATHYRGT | | CGGCCCACTGTTTCGACAAAAT | |
| | WYLTGIVSWGQG | | CAAGAACTGGAGGAACCTGATC | |
| | CATVGHFGVYTRV | | GCGGTGCTGGGCGAGCACGACC | |
| | SQYIEWLQKLMRS | | TCAGCGAGCACGACGGGGATG | |
| | EPRPGVLLRAPFPG | | AGCAGAGCCGGCGGGTGGCGC | |
| | KLTRAETGGSPAG | | AGGTCATCATCCCCAGCACGTA | |
| | SPTSTEEGTSESAT | | CGTCCCGGGCACCACCAACCAC | |
| | PESGPGTSTEPSEG | | GACATCGCGCTGCTCCGCCTGC | |
| | SAPGSPAGSPTSTE | | ACCAGCCCGTGGTCCTCACTGA | |
| | EGTSTEPSEGSAPG | | CCATGTGGTGCCCCTCTGCCTG | |
| | TSTEPSEGSAPGTS | | CCCGAACGGACGTTCTCTGAGA | |
| | ESATPESGPGSEPA | | GGACGCTGGCCTTCGTGCGCTT | |
| | TSGSETPGSEPATS | | CTCATTGGTCAGCGGCTGGGGC | |
| | GSETPGSPAGSPTS | | CAGCTGCTGGACCGTGGCGCCA | |
| | TEEGTSESATPESG | | CGGCCCTGGAGCTCATGGTCCT | |
| | PGTSTEPSEGSAPG | | CAACGTGCCCCGGCTGATGACC | |
| | TSTEPSEGSAPGSP | | CAGGACTGCCTGCAGCAGTCAC | |
| | AGSPTSTEEGTSTE | | GGAAGGTGGGAGACTCCCAA | |
| | PSEGSAPGTSTEPS | | ATATCACGGAGTACATGTTCTG | |
| | EGSAPGTSESATPE | | TGCCGGCTACTCGGATGGCAGC | |
| | SGPGTSTEPSEGSA | | AAGGACTCCTGCAAGGGGGAC | |
| | PGTSESATPESGPG | | AGTGGAGGCCCACATGCCACCC | |
| | SEPATSGSETPGTS | | ACTACCGGGGCACGTGGTACCT | |
| | TEPSEGSAPGTSTE | | GACGGGCATCGTCAGCTGGGGC | |
| | PSEGSAPGTSESAT | | CAGGGCTGCGCAACCGTGGGCC | |
| | PESGPGTSESATPE | | ACTTTGGGGTGTACACCAGGGT | |
| | SGPGSPAGSPTSTE | | CTCCCAGTACATCGAGTGGCTG | |
| | EGTSESATPESGPG | | CAAAAGCTCATGCGCTCAGAGC | |
| | SEPATSGSETPGTS | | CACGCCCAGGAGTCCTCCTGCG | |
| | ESATPESGPGTSTE | | AGCCCCATTTCCCGGT0GGTGGT | |
| | PSEGSAPGTSTEPS | | AGCCCGGCTGGCTCTCCTACCT | |
| | EGSAPGTSTEPSEG | | CTACTGAGGAAGGTACTTCTGA | |
| | SAPGTSTEPSEGSA | | AAGCGCTACTCCTGAGTCTGGT | |
| | PGTSTEPSEGSAPG | | CCAGGTACCTCTACTGAACCGT | |
| | TSTEPSEGSAPGSP | | CCGAAGGTAGCGCTCCAGGTAG | |
| | AGSPTSTEEGTSTE | | CCCAGCAGGCTCTCCGACTTCC | |
| | PSEGSAPGTSESAT | | ACTGAGGAAGGTACTTCTACTG | |
| | PESGPGSEPATSGS | | AACCTTCCGAAGGCAGCGCACC | |
| | ETPGTSESATPESG | | AGGTACCTCTACTGAACCTTCT | |
| | PGSEPATSGSETPG | | GAGGGCAGCGCTCCAGGTACTT | |
| | TSESATPESGPGTS | | CTGAAAGCGCTACCCCGGAATC | |
| | TEPSEGSAPGTSES | | TGGCCCAGGTAGCGAACCGGCT | |
| | ATPESGPGSPAGSP | | ACTTCTGGTTCTGAAACCCCAG | |
| | TSTEEGSPAGSPTS | | GTAGCGAACCGGCTACCTCCGG | |
| | TEEGSPAGSPTSTE | | TTCTGAAACTCCAGGTAGCCCG | |
| | EGTSESATPESGPG | | GCAGGCTCTCCGACCTCTACTG | |
| | TSTEPSEGSAPGTS | | AGGAAGGTACTTCTGAAAGCGC | |
| | ESATPESGPGSEPA | | AACCCCGGAGTCCGGCCCAGGT | |
| | TSGSETPGTSESAT | | ACCTCTACCGAACCGTCTGAGG | |
| | PESGPGSEPATSGS | | GCAGCGCACCAGGTACTTCTAC | |
| | ETPGTSESATPESG | | CGAACCGTCCGAGGGTAGCGCA | |
| | PGTSTEPSEGSAPG | | CCAGGTAGCCCAGCAGGTTCTC | |
| | SPAGSPTSTEEGTS | | CTACCTCCACCGAGGAAGGTAC | |
| | ESATPESGPGSEPA | | TTCTACCGAACCGTCCGAGGGT | |
| | TSGSETPGTSESAT | | AGCGCACCAGGTACCTCTACTG | |
| | PESGPGSPAGSPTS | | AACCTTCTGAGGGCAGCGCTCC | |
| | TEEGSPAGSPTSTE | | AGGTACTTCTGAAAGCGCTACC | |
| | EGTSTEPSEGSAPG | | CCGGAGTCCGGTCAGGTACTT | |
| | TSESATPESGPGTS | | CTACTGAACCGTCCGAAGGTAG | |
| | ESATPESGPGTSES | | CGCACCAGGTACTTCTGAAAGC | |
| | ATPESGPGSEPATS | | GCAACCCCTGAATCCGGTCCAG | |
| | GSETPGSEPATSGS | | GTAGCGAACCGGCTACTTCTGG | |
| | ETPGSPAGSPTSTE | | CTCTGAGACTCCAGGTACTTCT | |
| | EGTSTEPSEGSAPG | | ACCGAACCGTCCGAAGGTAGCG | |
| | TSTEPSEGSAPGSE | | CACCAGGTACTTCTACTGAACC | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | PATSGSETPGTSES ATPESGPGTSTEPS EGSAP | | GTCTGAAGGTAGCGCACCAGGT ACTTCTGAAAGCGCAACCCCGG AATCCGGCCCAGGTACCTCTGA AAGCGCAACCCCGGAGTCCGGC CCAGGTAGCCCTGCTGGCTCTC CAACCTCCACCGAAGAAGGTAC CTCTGAAAGCGCAACCCCTGAA TCCGGCCCAGGTAGCGAACCGG CAACCTCCGGTTCTGAAACCCC AGGTACCTCTGAAAGCGCTACT CCGGAGTCTGGCCCAGGTACCT CTACTGAACCGTCTGAGGGTAG CGCTCCAGGTACTTCTACTGAA CCGTCCGAAGGTAGCGCACCAG GTACTTCTACCGAACCGTCCGA AGGCAGCGCTCCAGGTACCTCT ACTGAACCTTCCGAGGGCAGCG CTCCAGGTACCTCTACCGAACC TTCTGAAGGTAGCGCACCAGGT ACTTCTACCGAACCGTCCGAGG GTAGCGCACCAGGTAGCCCAGC AGGTTCTCCTACCTCCACCGAG GAAGGTACTTCTACCGAACCGT CCGAGGGTAGCGCACCAGGTAC CTCTGAAAGCGCAACTCCTGAG TCTGGCCCAGGTAGCGAACCTG CTACCTCCGGCTCTGAGACTCC AGGTACCTCTGAAAGCGCAACC CCGGAATCTGGTCCAGGTAGCG AACCTGCAACCTCTGGCTCTGA AACCCCAGGTACCTCTGAAAGC GCTACTCCTGAATCTGGCCCAG GTACTTCTACTGAACCGTCCGA GGGCAGCGCACCAGGTACTTCT GAAAGCGCTACTCCTGAGTCCG GCCCAGGTAGCCCGGCTGGCTC TCCGACTTCCACCGAGGAAGGT AGCCCGGCTGGCTCTCCAACTT CTACTGAAGAAGGTAGCCCGGC AGGCTCTCCGACCTCTACTGAG GAAGGTACTTCTGAAAGCGCAA CCCCGGAGTCCGGCCCAGGTAC CTCTACCGAACCGTCTGAGGGC AGCGCACCAGGTACCTCTGAAA GCGCAACTCCTGAGTCTGGCCC AGGTAGCGAACCTGCTACCTCC GGCTCTGAGACTCCAGGTACCT CTGAAAGCGCAACCCCGGAATC TGGTCCAGGTAGCGAACCTGCA ACCTCTGGCTCTGAAACCCCAG GTACCTCTGAAAGCGCTACTCC TGAATCTGGCCCAGGTACTTCT ACTGAACCGTCCGAGGGCAGCG CACCAGGTAGCCCTGCTGGCTC TCCAACCTCCACCGAAGAAGGT ACCTCTGAAAGCGCAACCCCTG AATCCGGCCCAGGTAGCGAACC GGCAACCTCCGGTTCTGAAACC CCAGGTACTTCTGAAAGCGCTA CTCCTGAGTCCGGCCCAGGTAG CCCGGCTGGCTCTCCGACTTCC ACCGAGGAAGGTAGCCCGGCTG GCTCTCCAACTTCTACTGAAGA AGGTACTTCTACCGAACCTTCC GAGGGCAGCGCACCAGGTACTT CTGAAAGCGCTACCCCTGAGTC CGGCCCAGGTACTTCTGAAAGC GCTACTCCTGAATCGGTCCAG GTACTTCTGAAAGCGCTACCCC GGAATCTGGCCCAGGTAGCGAA CCGGCTACTTCTGGTTCTGAAA CCCCAGGTAGCGAACCGGCTAC CTCCGGTTCTGAAACTCCAGGT | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | AGCCCAGCAGGCTCTCCGACTT CCACTGAGGAAGGTACTTCTAC TGAACCTTCCGAAGGCAGCGCA CCAGGTACCTCTACTGAACCTT CTGAGGGCAGCGCTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCA | |
| FIX-FXIa-AE288 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGK LTRAETGGTSESA TPESGPGSEPATSG SETPGTSESATPES GPGSEPATSGSETP GTSESATPESGPGT STEPSEGSAPGSPA GSPTSTEEGTSESA TPESGPGSEPATSG SETPGTSESATPES GPGSPAGSPTSTEE GSPAGSPTSTEEGT STEPSEGSAPGTSE SATPESGPGTSESA TPESGPGTSESATP ESGPGSEPATSGSE TPGSEPATSGSETP GSPAGSPTSTEEGT STEPSEGSAPGTST EPSEGSAPGSEPAT SGSETPGTSESATP ESGPGTSTEPSEGS AP | 706 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGTGGGT GGTACCTCTGAAAGCGCAACTC CTGAGTCTGGCCCAGGTAGCGA ACCTGCTACCTCCGGCTCTGAG ACTCCAGGTACCTCTGAAAGCG CAACCCCGGAATCTGGTCCAGG | 707 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCAGGTA GCCCTGCTGGCTCTCCAACCTC CACCGAAGAAGGTACCTCTGAA AGCGCAACCCCTGAATCCGGCC CAGGTAGCGAACCGGCAACCTC CGGTTCTGAAACCCCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTACTTC TACCGAACCTTCCGAGGGCAGC GCACCAGGTACTTCTGAAAGCG CTACCCCTGAGTCCGGCCCAGG TACTTCTGAAAGCGCTACTCCT GAATCCGGTCCAGGTACTTCTG AAAGCGCTACCCCGGAATCTGG CCCAGGTAGCGAACCGGCTACT TCTGGTTCTGAAACCCCAGGTA GCGAACCGGCTACCTCCGGTTC TGAAACTCCAGGTAGCCCAGCA GGCTCTCCGACTTCCACTGAGG AAGGTACTTCTACTGAACCTTC CGAAGGCAGCGCACCAGGTACC TCTACTGAACCTTCTGAGGGCA GCGCTCCAGGTAGCGAACCTGC AACCTCTGGCTCTGAAACCCCA GGTACCTCTGAAAGCGCTACTC CTGAATCTGGCCCAGGTACTTC TACTGAACCGTCCGAGGGCAGC GCACCA | |
| FIX-FXIa-AE864 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGK LTRAETGGSPAGS PTSTEEGTSESATP ESGPGTSTEPSEGS APGSPAGSPTSTEE GTSTEPSEGSAPGT | 708 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT | 709 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | STEPSEGSAPGTSE | | TCTGGAACTGGACGAACCCTTA | |
| | SATPESGPGSEPAT | | GTGCTAAACAGCTACGTTACAC | |
| | SGSETPGSEPATSG | | CTATTTGCATTGCTGACAAGGA | |
| | SETPGSPAGSPTST | | ATACACGAACATCTTCCTCAAA | |
| | EEGTSESATPESGP | | TTTGGATCTGGCTATGTAAGTG | |
| | GTSTEPSEGSAPGT | | GCTGGGGAAGAGTCTTCCACAA | |
| | STEPSEGSAPGSPA | | AGGGAGATCAGCTTTAGTTCTT | |
| | GSPTSTEEGTSTEP | | CAGTACCTTAGAGTTCCACTTG | |
| | SEGSAPGTSTEPSE | | TTGACCGAGCCACATGTCTTCG | |
| | GSAPGTSESATPES | | ATCTACAAAGTTCACCATCTAT | |
| | GPGTSTEPSEGSAP | | AACAACATGTTCTGTGCTGGCT | |
| | GTSESATPESGPGS | | TCCATGAAGGAGGTAGAGATTC | |
| | EPATSGSETPGTST | | ATGTCAAGGAGATAGTGGGGG | |
| | EPSEGSAPGTSTEP | | ACCCCATGTTACTGAAGTGGAA | |
| | SEGSAPGTSESATP | | GGGACCAGTTTCTTAACTGGAA | |
| | ESGPGTSESATPES | | TTATTAGCTGGGGTGAAGAGTG | |
| | GPGSPAGSPTSTEE | | TGCAATGAAAGGCAAATATGGA | |
| | GTSESATPESGPGS | | ATATATACCAAGGTATCCCGGT | |
| | EPATSGSETPGTSE | | ATGTCAACTGGATTAAGGAAAA | |
| | SATPESGPGTSTEP | | AACAAAGCTCACTGGGGT0GGT | |
| | SEGSAPGTSTEPSE | | GGTAGCCCGGCTGGCTCTCCTA | |
| | GSAPGTSTEPSEGS | | CCTCTACTGAGGAAGGTACTTC | |
| | APGTSTEPSEGSAP | | TGAAAGCGCTACTCCTGAGTCT | |
| | GTSTEPSEGSAPGT | | GGTCCAGGTACCTCTACTGAAC | |
| | STEPSEGSAPGSPA | | CGTCCGAAGGTAGCGCTCCAGG | |
| | GSPTSTEEGTSTEP | | TAGCCCAGCAGGCTCTCCGACT | |
| | SEGSAPGTSESATP | | TCCACTGAGGAAGGTACTTCTA | |
| | ESGPGSEPATSGSE | | CTGAACCTTCCGAAGGCAGCGC | |
| | TPGTSESATPESGP | | ACCAGGTACCTCTACTGAACCT | |
| | GSEPATSGSETPGT | | TCTGAGGGCAGCGCTCCAGGTA | |
| | SESATPESGPGTST | | CTTCTGAAAGCGCTACCCCGGA | |
| | EPSEGSAPGTSESA | | ATCTGGCCCAGGTAGCGAACCG | |
| | TPESGPGSPAGSPT | | GCTACTTCTGGTTCTGAAACCC | |
| | STEEGSPAGSPTST | | CAGGTAGCGAACCGGCTACCTC | |
| | EEGSPAGSPTSTEE | | CGGTTCTGAAACTCCAGGTAGC | |
| | GTSESATPESGPGT | | CCGGCAGGCTCTCCGACCTCTA | |
| | STEPSEGSAPGTSE | | CTGAGGAAGGTACTTCTGAAAG | |
| | SATPESGPGSEPAT | | CGCAACCCCGGAGTCCGGCCCA | |
| | SGSETPGTSESATP | | GGTACCTCTACCGAACCGTCTG | |
| | ESGPGSEPATSGSE | | AGGGCAGCGCACCAGGTACTTC | |
| | TPGTSESATPESGP | | TACCGAACCGTCCGAGGGTAGC | |
| | GTSTEPSEGSAPGS | | GCACCAGGTAGCCCAGCAGGTT | |
| | PAGSPTSTEEGTSE | | CTCCTACCTCCACCGAGGAAGG | |
| | SATPESGPGSEPAT | | TACTTCTACCGAACCGTCCGAG | |
| | SGSETPGTSESATP | | GGTAGCGCACCAGGTACCTCTA | |
| | ESGPGSPAGSPTST | | CTGAACCTTCTGAGGGCAGCGC | |
| | EEGSPAGSPTSTEE | | TCCAGGTACTTCTGAAAGCGCT | |
| | GTSTEPSEGSAPGT | | ACCCCGGAGTCCGGTCCAGGTA | |
| | SESATPESGPGTSE | | CTTCTACTGAACCGTCCGAAGG | |
| | SATPESGPGTSESA | | TAGCGCACCAGGTACTTCTGAA | |
| | TPESGPGSEPATSG | | AGCGCAACCCCTGAATCCGGTC | |
| | SETPGSEPATSGSE | | CAGGTAGCGAACCGGCTACTTC | |
| | TPGSPAGSPTSTEE | | TGGCTCTGAGACTCCAGGTACT | |
| | GTSTEPSEGSAPGT | | TCTACCGAACCGTCCGAAGGTA | |
| | STEPSEGSAPGSEP | | GCGCACCAGGTACTTCTACTGA | |
| | ATSGSETPGTSESA | | ACCGTCTGAAGGTAGCGCACCA | |
| | TPESGPGTSTEPSE | | GGTACTTCTGAAAGCGCAACCC | |
| | GSAP | | CGGAATCCGGCCCAGGTACCTC | |
| | | | TGAAAGCGCAACCCCGGAGTCC | |
| | | | GGCCCAGGTAGCCCTGCTGGCT | |
| | | | CTCCAACCTCCACCGAAGAAGG | |
| | | | TACCTCTGAAAGCGCAACCCCT | |
| | | | GAATCCGGCCCAGGTAGCGAAC | |
| | | | CGGCAACCTCCGGTTCTGAAAC | |
| | | | CCCAGGTACCTCTGAAAGCGCT | |
| | | | ACTCCGGAGTCTGGCCCAGGTA | |
| | | | CCTCTACTGAACCGTCTGAGGG | |
| | | | TAGCGCTCCAGGTACTTCTACT | |
| | | | GAACCGTCCGAAGGTAGCGCAC | |
| | | | CAGGTACTTCTACCGAACCGTC | |
| | | | CGAAGGCAGCGCTCCAGGTACC | |
| | | | TCTACTGAACCTTCCGAGGGCA | |
| | | | GCGCTCCAGGTACCTCTACCGA | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | ACCTTCTGAAGGTAGCGCACCA GGTACTTCTACCGAACCGTCCG AGGGTAGCGCACCAGGTAGCCC AGCAGGTTCTCCTACCTCCACC GAGGAAGGTACTTCTACCGAAC CGTCCGAGGGTAGCGCACCAGG TACCTCTGAAAGCGCAACTCCT GAGTCTGGCCCAGGTAGCGAAC CTGCTACCTCCGGCTCTGAGAC TCCAGGTACCTCTGAAAGCGCA ACCCCGGAATCTGGTCCAGGTA GCGAACCTGCAACCTCTGGCTC TGAAACCCCAGGTACCTCTGAA AGCGCTACTCCTGAATCTGGCC CAGGTACTTCTACTGAACCGTC CGAGGGCAGCGCACCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTAGCCC GGCAGGCTCTCCGACCTCTACT GAGGAAGGTACTTCTGAAAGCG CAACCCCGGAGTCCGGCCCAGG TACCTCTACCGAACCGTCTGAG GGCAGCGCACCAGGTACCTCTG AAAGCGCAACTCCTGAGTCTGG CCCAGGTAGCGAACCTGCTACC TCCGGCTCTGAGACTCCAGGTA CCTCTGAAAGCGCAACCCCGGA ATCTGGTCCAGGTAGCGAACCT GCAACCTCTGGCTCTGAAACCC CAGGTACCTCTGAAAGCGCTAC TCCTGAATCTGGCCCAGGTACT TCTACTGAACCGTCCGAGGGCA GCGCACCAGGTAGCCCTGCTGG CTCTCCAACCTCCACCGAAGAA GGTACCTCTGAAAGCGCAACCC CTGAATCCGGCCCAGGTAGCGA ACCGGCAACCTCCGGTTCTGAA ACCCCAGGTACTTCTGAAAGCG CTACTCCTGAGTCCGGCCCAGG TAGCCCGGCTGGCTCTCCGACT TCCACCGAGGAAGGTAGCCCGG CTGGCTCTCCAACTTCTACTGA AGAAGGTACTTCTACCGAACCT TCCGAGGGCAGCGCACCAGGTA CTTCTGAAAGCGCTACCCCTGA GTCCGGCCCAGGTACTTCTGAA AGCGCTACTCCTGAATCCGGTC CAGGTACTTCTGAAAGCGCTAC CCCGGAATCTGGCCCAGGTAGC GAACCGGCTACTTCTGGTTCTG AAACCCCAGGTAGCGAACCGGC TACCTCCGGTTCTGAAACTCCA GGTAGCCCAGCAGGCTCTCCGA CTTCCACTGAGGAAGGTACTTC TACTGAACCTTCCGAAGGCAGC GCACCAGGTACCTCTACTGAAC CTTCTGAGGGCAGCGCTCCAGG TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCA | |
| FVII-FXIIa-AE288 | ANAFLEELRPGSLE RECKEEQCSFEEA REIFKDAERTKLF WISYSDGDQCASS PCQNGGSCKDQLQ SYICFCLPAFEGRN CETHKDDQLICVN | 710 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT | 711 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | ENGGCEQYCSDHT | | CAAGTCCATGCCAGAATGGGGG | |
| | GTKRSCRCHEGYS | | CTCCTGCAAGGACCAGCTCCAG | |
| | LLADGVSCTPTVE | | TCCTATATCTGCTTCTGCCTCCC | |
| | YPCGKIPILEKRNA | | TGCCTTCGAGGGCCGGAACTGT | |
| | SKPQGRIVGGKVC | | GAGACGCACAAGGATGACCAG | |
| | PKGECPWQVLLLV | | CTGATCTGTGTGAACGAGAACG | |
| | NGAQLCGGTLINTI | | GCGGCTGTGAGCAGTACTGCAG | |
| | WVVSAAHCFDKIK | | TGACCACACGGGCACCAAGCGC | |
| | NWRNLIAVLGEHD | | TCCTGTCGGTGCCACGAGGGGT | |
| | LSEHDGDEQSRRV | | ACTCTCTGCTGGCAGACGGGGT | |
| | AQVIIPSTYVPGTT | | GTCCTGCACACCCACAGTTGAA | |
| | NHDIALLRLHQPV | | TATCCATGTGGAAAAATACCTA | |
| | VLTDHVVPLCLPE | | TTCTAGAAAAAGAAATGCCAG | |
| | RTFSERTLAFVRFS | | CAAACCCCAAGGCCGAATTGTG | |
| | LVSGWGQLLDRG | | GGGGGCAAGGTGTGCCCCAAA | |
| | ATALELMVLNVPR | | GGGGAGTGTCCATGGCAGGTCC | |
| | LMTQDCLQQSRK | | TGTTGTTGGTGAATGGAGCTCA | |
| | VGDSPNITEYMFC | | GTTGTGTGGGGGGACCCTGATC | |
| | AGYSDGSKDSCKG | | AACACCATCTGGGTGGTCTCCG | |
| | DSGGPHATHYRGT | | CGGCCCACTGTTTCGACAAAAT | |
| | WYLTGIVSWGQG | | CAAGAACTGGAGGAACCTGATC | |
| | CATVGHFGVYTRV | | GCGGTGCTGGGCGAGCACGACC | |
| | SQYIEWLQKLMRS | | TCAGCGAGCACGACGGGGATG | |
| | EPRPGVLLRAPFPG | | AGCAGAGCCGGCGGGTGGCGC | |
| | TMTRIVGGGGTSE | | AGGTCATCATCCCCAGCACGTA | |
| | SATPESGPGSEPAT | | CGTCCCGGGCACCACCAACCAC | |
| | SGSETPGTSESATP | | GACATCGCGCTGCTCCGCCTGC | |
| | ESGPGSEPATSGSE | | ACCAGCCCGTGGTCCTCACTGA | |
| | TPGTSESATPESGP | | CCATGTGGTGCCCCTCTGCCTG | |
| | GTSTEPSEGSAPGS | | CCCGAACGGACGTTCTCTGAGA | |
| | PAGSPTSTEEGTSE | | GGACGCTGGCCTTCGTGCGCTT | |
| | SATPESGPGSEPAT | | CTCATTGGTCAGCGGCTGGGGC | |
| | SGSETPGTSESATP | | CAGCTGCTGGACCGTGGCGCCA | |
| | ESGPGSPAGSPTST | | CGGCCCTGGAGCTCATGGTCCT | |
| | EEGSPAGSPTSTEE | | CAACGTGCCCCGGCTGATGACC | |
| | GTSTEPSEGSAPGT | | CAGGACTGCCTGCAGCAGTCAC | |
| | SESATPESGPGTSE | | GGAAGGTGGGAGACTCCCAA | |
| | SATPESGPGTSESA | | ATATCACGGAGTACATGTTCTG | |
| | TPESGPGSEPATSG | | TGCCGGCTACTCGGATGGCAGC | |
| | SETPGSEPATSGSE | | AAGGACTCCTGCAAGGGGGAC | |
| | TPGSPAGSPTSTEE | | AGTGGAGGCCCACATGCCACCC | |
| | GTSTEPSEGSAPGT | | ACTACCGGGGCACGTGGTACCT | |
| | STEPSEGSAPGSEP | | GACGGGCATCGTCAGCTGGGGC | |
| | ATSGSETPGTSESA | | CAGGGCTGCGCAACCGTGGGCC | |
| | TPESGPGTSTEPSE | | ACTTTGGGGTGTACACCAGGGT | |
| | GSAP | | CTCCCAGTACATCGAGTGGCTG | |
| | | | CAAAAGCTCATGCGCTCAGAGC | |
| | | | CACGCCCAGGAGTCCTCCTGCG | |
| | | | AGCCCCATTTCCCGGT0GGTGGT | |
| | | | ACCTCTGAAAGCGCAACTCCTG | |
| | | | AGTCTGGCCCAGGTAGCGAACC | |
| | | | TGCTACCTCCGGCTCTGAGACT | |
| | | | CCAGGTACCTCTGAAAGCGCAA | |
| | | | CCCCGGAATCTGGTCCAGGTAG | |
| | | | CGAACCTGCAACCTCTGGCTCT | |
| | | | GAAACCCCAGGTACCTCTGAAA | |
| | | | GCGCTACTCCTGAATCTGGCCC | |
| | | | AGGTACTTCTACTGAACCGTCC | |
| | | | GAGGGCAGCGCACCAGGTAGC | |
| | | | CCTGCTGGCTCTCCAACCTCCA | |
| | | | CCGAAGAAGGTACCTCTGAAAG | |
| | | | CGCAACCCCTGAATCCGGCCCA | |
| | | | GGTAGCGAACCGGCAACCTCCG | |
| | | | GTTCTGAAACCCCAGGTACTTC | |
| | | | TGAAAGCGCTACTCCTGAGTCC | |
| | | | GGCCCAGGTAGCCCGGCTGGCT | |
| | | | CTCCGACTTCCACCGAGGAAGG | |
| | | | TAGCCCGGCTGGCTCTCCAACT | |
| | | | TCTACTGAAGAAGGTACTTCTA | |
| | | | CCGAACCTTCCGAGGGCAGCGC | |
| | | | ACCAGGTACTTCTGAAAGCGCT | |
| | | | ACCCCTGAGTCCGGCCCAGGTA | |
| | | | CTTCTGAAAGCGCTACTCCTGA | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | ATCCGGTCCAGGTACTTCTGAA AGCGCTACCCCGGAATCTGGCC CAGGTAGCGAACCGGCTACTTC TGGTTCTGAAACCCCAGGTAGC GAACCGGCTACCTCCGGTTCTG AAACTCCAGGTAGCCCAGCAGG CTCTCCGACTTCCACTGAGGAA GGTACTTCTACTGAACCTTCCG AAGGCAGCGCACCAGGTACCTC TACTGAACCTTCTGAGGGCAGC GCTCCAGGTAGCGAACCTGCAA CCTCTGGCTCTGAAACCCCAGG TACCTCTGAAAGCGCTACTCCT GAATCTGGCCCAGGTACTTCTA CTGAACCGTCCGAGGGCAGCGC ACCA | |
| FVII-FXIIa-AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG TMTRIVGGGGSPA GSPTSTEEGTSESA TPESGPGTSTEPSE GSAPGSPAGSPTST EEGTSTEPSEGSAP GTSTEPSEGSAPGT SESATPESGPGSEP ATSGSETPGSEPAT SGSETPGSPAGSPT STEEGTSESATPES GPGTSTEPSEGSAP GTSTEPSEGSAPGS PAGSPTSTEEGTST EPSEGSAPGTSTEP SEGSAPGTSESATP ESGPGTSTEPSEGS APGTSESATPESGP GSEPATSGSETPGT STEPSEGSAPGTST EPSEGSAPGTSESA TPESGPGTSESATP ESGPGSPAGSPTST EEGTSESATPESGP GSEPATSGSETPGT SESATPESGPGTST | 712 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGTGGTGGT | 713 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | EPSEGSAPGTSTEP | | AGCCCGGCTGGCTCTCCTACCT | |
| | SEGSAPGTSTEPSE | | CTACTGAGGAAGGTACTTCTGA | |
| | GSAPGTSTEPSEGS | | AAGCGCTACTCCTGAGTCTGGT | |
| | APGTSTEPSEGSAP | | CCAGGTACCTCTACTGAACCGT | |
| | GTSTEPSEGSAPGS | | CCGAAGGTAGCGCTCCAGGTAG | |
| | PAGSPTSTEEGTST | | CCCAGCAGGCTCTCCGACTTCC | |
| | EPSEGSAPGTSESA | | ACTGAGGAAGGTACTTCTACTG | |
| | TPESGPGSEPATSG | | AACCTTCCGAAGGCAGCGCACC | |
| | SETPGTSESATPES | | AGGTACCTCTACTGAACCTTCT | |
| | GPGSEPATSGSETP | | GAGGGCAGCGCTCCAGGTACTT | |
| | GTSESATPESGPGT | | CTGAAAGCGCTACCCCGGAATC | |
| | STEPSEGSAPGTSE | | TGGCCCAGGTAGCGAACCGGCT | |
| | SATPESGPGSPAGS | | ACTTCTGGTTCTGAAACCCCAG | |
| | PTSTEEGSPAGSPT | | GTAGCGAACCGGCTACCTCCGG | |
| | STEEGSPAGSPTST | | TTCTGAAACTCCAGGTAGCCCG | |
| | EEGTSESATPESGP | | GCAGGCTCTCCGACCTCTACTG | |
| | GTSTEPSEGSAPGT | | AGGAAGGTACTTCTGAAAGCGC | |
| | SESATPESGPGSEP | | AACCCCGGAGTCCGGCCCAGGT | |
| | ATSGSETPGTSESA | | ACCTCTACCGAACCGTCTGAGG | |
| | TPESGPGSEPATSG | | GCAGCGCACCAGGTACTTCTAC | |
| | SETPGTSESATPES | | CGAACCGTCCGAGGGTAGCGCA | |
| | GPGTSTEPSEGSAP | | CCAGGTAGCCCAGCAGGTTCTC | |
| | GSPAGSPTSTEEGT | | CTACCTCCACCGAGGAAGGTAC | |
| | SESATPESGPGSEP | | TTCTACCGAACCGTCCGAGGGT | |
| | ATSGSETPGTSESA | | AGCGCACCAGGTACCTCTACTG | |
| | TPESGPGSPAGSPT | | AACCTTCTGAGGGCAGCGCTCC | |
| | STEEGSPAGSPTST | | AGGTACTTCTGAAAGCGCTACC | |
| | EEGTSTEPSEGSAP | | CCGGAGTCCGGTCCAGGTACTT | |
| | GTSESATPESGPGT | | CTACTGAACCGTCCGAAGGTAG | |
| | SESATPESGPGTSE | | CGCACCAGGTACTTCTGAAAGC | |
| | SATPESGPGSEPAT | | GCAACCCCTGAATCCGGTCCAG | |
| | SGSETPGSEPATSG | | GTAGCGAACCGGCTACTTCTGG | |
| | SETPGSPAGSPTST | | CTCTGAGACTCCAGGTACTTCT | |
| | EEGTSTEPSEGSAP | | ACCGAACCGTCCGAAGGTAGCG | |
| | GTSTEPSEGSAPGS | | CACCAGGTACTTCTACTGAACC | |
| | EPATSGSETPGTSE | | GTCTGAAGGTAGCGCACCAGGT | |
| | SATPESGPGTSTEP | | ACTTCTGAAAGCGCAACCCCGG | |
| | SEGSAP | | AATCCGGCCCAGGTACCTCTGA | |
| | | | AAGCGCAACCCCGGAGTCCGGC | |
| | | | CCAGGTAGCCCTGCTGGCTCTC | |
| | | | CAACCTCCACCGAAGAAGGTAC | |
| | | | CTCTGAAAGCGCAACCCCTGAA | |
| | | | TCCGGCCCAGGTAGCGAACCGG | |
| | | | CAACCTCCGGTTCTGAAACCCC | |
| | | | AGGTACCTCTGAAAGCGCTACT | |
| | | | CCGGAGTCTGGCCCAGGTACCT | |
| | | | CTACTGAACCGTCTGAGGGTAG | |
| | | | CGCTCCAGGTACTTCTACTGAA | |
| | | | CCGTCCGAAGGTAGCGCACCAG | |
| | | | GTACTTCTACCGAACCGTCCGA | |
| | | | AGGCAGCGCTCCAGGTACCTCT | |
| | | | ACTGAACCTTCCGAGGGCAGCG | |
| | | | CTCCAGGTACCTCTACCGAACC | |
| | | | TTCTGAAGGTAGCGCACCAGGT | |
| | | | ACTTCTACCGAACCGTCCGAGG | |
| | | | GTAGCGCACCAGGTAGCCCAGC | |
| | | | AGGTTCTCCTACCTCCACCGAG | |
| | | | GAAGGTACTTCTACCGAACCGT | |
| | | | CCGAGGGTAGCGCACCAGGTAC | |
| | | | CTCTGAAAGCGCAACTCCTGAG | |
| | | | TCTGGCCCAGGTAGCGAACCTG | |
| | | | CTACCTCCGGCTCTGAGACTCC | |
| | | | AGGTACCTCTGAAAGCGCAACC | |
| | | | CCGGAATCTGGTCCAGGTAGCG | |
| | | | AACCTGCAACCTCTGGCTCTGA | |
| | | | AACCCCAGGTACCTCTGAAAGC | |
| | | | GCTACTCCTGAATCTGGCCCAG | |
| | | | GTACTTCTACTGAACCGTCCGA | |
| | | | GGGCAGCGCACCAGGTACTTCT | |
| | | | GAAAGCGCTACTCCTGAGTCCG | |
| | | | GCCCAGGTAGCCCGGCTGGCTC | |
| | | | TCCGACTTCCACCGAGGAAGGT | |
| | | | AGCCCGGCTGGCTCTCCAACTT | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | CTACTGAAGAAGGTAGCCCGGC AGGCTCTCCGACCTCTACTGAG GAAGGTACTTCTGAAAGCGCAA CCCCGGAGTCCGGCCCAGGTAC CTCTACCGAACCGTCTGAGGGC AGCGCACCAGGTACCTCTGAAA GCGCAACTCCTGAGTCTGGCCC AGGTAGCGAACCTGCTACCTCC GGCTCTGAGACTCCAGGTACCT CTGAAAGCGCAACCCCGGAATC TGGTCCAGGTAGCGAACCTGCA ACCTCTGGCTCTGAAACCCCAG GTACCTCTGAAAGCGCTACTCC TGAATCTGGCCCAGGTACTTCT ACTGAACCGTCCGAGGGCAGCG CACCAGGTAGCCCTGCTGGCTC TCCAACCTCCACCGAAGAAGGT ACCTCTGAAAGCGCAACCCCTG AATCCGGCCCAGGTAGCGAACC GGCAACCTCCGGTTCTGAAACC CCAGGTACTTCTGAAAGCGCTA CTCCTGAGTCCGGCCCAGGTAG CCCGGCTGGCTCTCCGACTTCC ACCGAGGAAGGTAGCCCGGCTG GCTCTCCAACTTCTACTGAAGA AGGTACTTCTACCGAACCTTCC GAGGGCAGCGCACCAGGTACTT CTGAAAGCGCTACCCCTGAGTC CGGCCCAGGTACTTCTGAAAGC GCTACTCCTGAATCCGGTCCAG GTACTTCTGAAAGCGCTACCCC GGAATCTGGCCCAGGTAGCGAA CCGGCTACTTCTGGTTCTGAAA CCCCAGGTAGCGAACCGGCTAC CTCCGGTTCTGAAACTCCAGGT AGCCCAGCAGGCTCTCCGACTT CCACTGAGGAAGGTACTTCTAC TGAACCTTCCGAAGGCAGCGCA CCAGGTACCTCTACTGAACCTT CTGAGGGCAGCGCTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCA | |
| FIX-FXIIa-AE288 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA | 714 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA | 715 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | GFHEGGRDSCQGD SGGPHVTEVEGTS FLTGIISWGEECAM KGKYGIYTKVSRY VNWIKEKTKLTGT MTRIVGGGTSES ATPESGPGSEPATS GSETPGTSESATPE SGPGSEPATSGSET PGTSESATPESGPG TSTEPSEGSAPGSP AGSPTSTEEGTSES ATPESGPGSEPATS GSETPGTSESATPE SGPGSPAGSPTSTE EGSPAGSPTSTEEG TSTEPSEGSAPGTS ESATPESGPGTSES ATPESGPGTSESAT PESGPGSEPATSGS ETPGSEPATSGSET PGSPAGSPTSTEEG TSTEPSEGSAPGTS TEPSEGSAPGSEPA TSGSETPGTSESAT PESGPGTSTEPSEG SAP | | ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGTGGT GGTACCTCTGAAAGCGCAACTC CTGAGTCTGGCCCAGGTAGCGA ACCTGCTACCTCCGGCTCTGAG ACTCCAGGTACCTCTGAAAGCG CAACCCCGGAATCTGGTCCAGG TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCAGGTA GCCCTGCTGGCTCTCCAACCTC CACCGAAGAAGGTACCTCTGAA AGCGCAACCCCTGAATCCGGCC CAGGTAGCGAACCGGCAACCTC CGGTTCTGAAACCCCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTACTTC TACCGAACCTTCCGAGGGCAGC GCACCAGGTACTTCTGAAAGCG CTACCCCTGAGTCCGGCCCAGG TACTTCTGAAAGCGCTACTCCT GAATCCGGTCCAGGTACTTCTG AAAGCGCTACCCCGGAATCTGG CCCAGGTAGCGAACCGGCTACT TCTGGTTCTGAAACCCCAGGTA GCGAACCGGCTACCTCCGGTTC TGAAACTCCAGGTAGCCCAGCA GGCTCTCCGACTTCCACTGAGG AAGGTACTTCTACTGAACTTC CGAAGGCAGCGCACCAGGTACC TCTACTGAACCTTCTGAGGGCA GCGCTCCAGGTAGCGAACCTGC AACCTCTGGCTCTGAAACCCCA GGTACCTCTGAAAGCGCTACTC CTGAATCTGGCCCAGGTACTTC TACTGAACCGTCCGAGGGCAGC GCACCA | |
| FIX-FXIIa- | YNSGKLEEFVQGN LERECMEEKCSFE | 716 | TATAATTCAGGTAAATTGGAAG AGTTTGTTCAAGGGAACCTTGA | 717 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| AE864 | EAREVFENTERTT | | GAGAGAATGTATGGAAGAAAA | |
| | EFWKQYVDGDQC | | GTGTAGTTTTGAAGAAGCACGA | |
| | ESNPCLNGGSCKD | | GAAGTTTTTGAAAACACTGAAA | |
| | DINSYECWCPFGF | | GAACAACTGAATTTTGGAAGCA | |
| | EGKNCELDVTCNI | | GTATGTTGATGGAGATCAGTGT | |
| | KNGRCEQFCKNSA | | GAGTCCAATCCATGTTTAAATG | |
| | DNKVVCSCTEGYR | | GCGGCAGTTGCAAGGATGACAT | |
| | LAENQKSCEPAVP | | TAATTCCTATGAATGTTGGTGTC | |
| | FPCGRVSVSQTSK | | CCTTTGGATTTGAAGGAAAGAA | |
| | LTRAETVFPDVDY | | CTGTGAATTAGATGTAACATGT | |
| | VNSTEAETILDNIT | | AACATTAAGAATGGCAGATGCG | |
| | QSTQSFNDFTRVV | | AGCAGTTTTGTAAAAATAGTGC | |
| | GGEDAKPGQFPW | | TGATAACAAGGTGGTTTGCTCC | |
| | QVVLNGKVDAFC | | TGTACTGAGGGATATCGACTTG | |
| | GGSIVNEKWIVTA | | CAGAAAACCAGAAGTCCTGTGA | |
| | AHCVETGVKITVV | | ACCAGCAGTGCCATTTCCATGT | |
| | AGEHNIEETEHTE | | GGAAGAGTTTCTGTTTCACAAA | |
| | QKRNVIRIIPHHNY | | CTTCTAAGCTCACCCGTGCTGA | |
| | NAAINKYNHDIAL | | GACTGTTTTTCCTGATGTGGACT | |
| | LELDEPLVLNSYV | | ATGTAAATTCTACTGAAGCTGA | |
| | TPICIADKEYTNIFL | | AACCATTTTGGATAACATCACT | |
| | KFGSGYVSGWGR | | CAAAGCACCCAATCATTTAATG | |
| | VPHKGRSALVLQY | | ACTTCACTCGGGTTGTTGGTGG | |
| | LRVPLVDRATCLR | | AGAAGATGCCAAACCAGGTCA | |
| | STKFTIYNNMFCA | | ATTCCCTTGGCAGGTTGTTTGA | |
| | GPHEGGRDSCQGD | | ATGGTAAAGTTGATGCATTCTG | |
| | SGGPHVTEVEGTS | | TGGAGGCTCTATCGTTAATGAA | |
| | FLTGIISWGEECAM | | AAATGGATTGTAACTGCTGCCC | |
| | KGKYGIYTKVSRY | | ACTGTGTTGAAACTGGTGTTAA | |
| | VNWIKEKTKLTGT | | AATTACAGTTGTCGCAGGTGAA | |
| | MTRIVGGGGSPAG | | CATAATATTGAGGAGACAGAAC | |
| | SPTSTEEGTSESAT | | ATACAGAGCAAAAGCGAAATG | |
| | PESGPGTSTEPSEG | | TGATTCGAATTATTCCTCACCAC | |
| | SAPGSPAGSPTSTE | | AACTACAATGCAGCTATTAATA | |
| | EGTSTEPSEGSAPG | | AGTACAACCATGACATTGCCCT | |
| | TSTEPSEGSAPGTS | | TCTGGAACTGGACGAACCCTTA | |
| | ESATPESGPGSEPA | | GTGCTAAACAGCTACGTTACAC | |
| | TSGSETPGSEPATS | | CTATTTGCATTGCTGACAAGGA | |
| | GSETPGSPAGSPTS | | ATACACGAACATCTTCCTCAAA | |
| | TEEGTSESATPESG | | TTTGGATCTGGCTATGTAAGTG | |
| | PGTSTEPSEGSAPG | | GCTGGGGAAGAGTCTTCCACAA | |
| | TSTEPSEGSAPGSP | | AGGGAGATCAGCTTTAGTTCTT | |
| | AGSPTSTEEGTSTE | | CAGTACCTTAGAGTTCCACTTG | |
| | PSEGSAPGTSTEPS | | TTGACCGAGCCACATGTCTTCG | |
| | EGSAPGTSESATPE | | ATCTACAAAGTTCACCATCTAT | |
| | SGPGTSTEPSEGSA | | AACAACATGTTCTGTGCTGGCT | |
| | PGTSESATPESGPG | | TCCATGAAGGAGGTAGAGATTC | |
| | SEPATSGSETPGTS | | ATGTCAAGGAGATAGTGGGGG | |
| | TEPSEGSAPGTSTE | | ACCCCATGTTACTGAAGTGGAA | |
| | PSEGSAPGTSESAT | | GGGACCAGTTTCTTAACTGGAA | |
| | PESGPGTSESATPE | | TTATTAGCTGGGGTGAAGAGTG | |
| | SGPGSPAGSPTSTE | | TGCAATGAAAGGCAAATATGGA | |
| | EGTSESATPESGPG | | ATATATACCAAGGTATCCCGGT | |
| | SEPATSGSETPGTS | | ATGTCAACTGGATTAAGGAAAA | |
| | ESATPESGPGTSTE | | AACAAAGCTCACTGGGGT0GGT | |
| | PSEGSAPGTSTEPS | | GGTAGCCCGGCTGGCTCTCCTA | |
| | EGSAPGTSTEPSEG | | CCTCTACTGAGGAAGGTACTTC | |
| | SAPGTSTEPSEGSA | | TGAAAGCGCTACTCCTGAGTCT | |
| | PGTSTEPSEGSAPG | | GGTCCAGGTACCTCTACTGAAC | |
| | TSTEPSEGSAPGSP | | CGTCCGAAGGTAGCGCTCCAGG | |
| | AGSPTSTEEGTSTE | | TAGCCCAGCAGGCTCTCCGACT | |
| | PSEGSAPGTSESAT | | TCCACTGAGGAAGGTACTTCTA | |
| | PESGPGSEPATSGS | | CTGAACCTTCCGAAGGCAGCGC | |
| | ETPGTSESATPESG | | ACCAGGTACCTCTACTGAACCT | |
| | PGSEPATSGSETPG | | TCTGAGGGCAGCGCTCCAGGTA | |
| | TSESATPESGPGTS | | CTTCTGAAAGCGCTACCCCGGA | |
| | TEPSEGSAPGTSES | | ATCTGGCCCAGGTAGCGAACCG | |
| | ATPESGPGSPAGSP | | GCTACTTCTGGTTCTGAAACCC | |
| | TSTEEGSPAGSPTS | | CAGGTAGCGAACCGGCTACCTC | |
| | TEEGSPAGSPTSTE | | CGGTTCTGAAACTCCAGGTAGC | |
| | EGTSESATPESGPG | | CCGGCAGGCTCTCCGACCTCTA | |
| | TSTEPSEGSAPGTS | | CTGAGGAAGGTACTTCTGAAAG | |
| | ESATPESGPGSEPA | | CGCAACCCCGGAGTCCGGCCCA | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | TSGSETPGTSESAT | | GGTACCTCTACCGAACCGTCTG | |
| | PESGPGSEPATSGS | | AGGGCAGCGCACCAGGTACTTC | |
| | ETPGTSESATPESG | | TACCGAACCGTCCGAGGGTAGC | |
| | PGTSTEPSEGSAPG | | GCACCAGGTAGCCCAGCAGGTT | |
| | SPAGSPTSTEEGTS | | CTCCTACCTCCACCGAGGAAGG | |
| | ESATPESGPGSEPA | | TACTTCTACCGAACCGTCCGAG | |
| | TSGSETPGTSESAT | | GGTAGCGCACCAGGTACCTCTA | |
| | PESGPGSPAGSPTS | | CTGAACCTTCTGAGGGCAGCGC | |
| | TEEGSPAGSPTSTE | | TCCAGGTACTTCTGAAAGCGCT | |
| | EGTSTEPSEGSAPG | | ACCCCGGAGTCCGGTCCAGGTA | |
| | TSESATPESGPGTS | | CTTCTACTGAACCGTCCGAAGG | |
| | ESATPESGPGTSES | | TAGCGCACCAGGTACTTCTGAA | |
| | ATPESGPGSEPATS | | AGCGCAACCCCTGAATCCGGTC | |
| | GSETPGSEPATSGS | | CAGGTAGCGAACCGGCTACTTC | |
| | ETPGSPAGSPTSTE | | TGGCTCTGAGACTCCAGGTACT | |
| | EGTSTEPSEGSAPG | | TCTACCGAACCGTCCGAAGGTA | |
| | TSTEPSEGSAPGSE | | GCGCACCAGGTACTTCTACTGA | |
| | PATSGSETPGTSES | | ACCGTCTGAAGGTAGCGCACCA | |
| | ATPESGPGTSTEPS | | GGTACTTCTGAAAGCGCAACCC | |
| | EGSAP | | CGGAATCCGGCCCAGGTACCTC | |
| | | | TGAAAGCGCAACCCCGGAGTCC | |
| | | | GGCCCAGGTAGCCCTGCTGGCT | |
| | | | CTCCAACCTCCACCGAAGAAGG | |
| | | | TACCTCTGAAAGCGCAACCCCT | |
| | | | GAATCCGGCCCAGGTAGCGAAC | |
| | | | CGGCAACCTCCGGTTCTGAAAC | |
| | | | CCCAGGTACCTCTGAAAGCGCT | |
| | | | ACTCCGGAGTCTGGCCCAGGTA | |
| | | | CCTCTACTGAACCGTCTGAGGG | |
| | | | TAGCGCTCCAGGTACTTCTACT | |
| | | | GAACCGTCCGAAGGTAGCGCAC | |
| | | | CAGGTACTTCTACCGAACCGTC | |
| | | | CGAAGGCAGCGCTCCAGGTACC | |
| | | | TCTACTGAACCTTCCGAGGGCA | |
| | | | GCGCTCCAGGTACCTCTACCGA | |
| | | | ACCTTCTGAAGGTAGCGCACCA | |
| | | | GGTACTTCTACCGAACCGTCCG | |
| | | | AGGGTAGCGCACCAGGTAGCCC | |
| | | | AGCAGGTTCTCCTACCTCCACC | |
| | | | GAGGAAGGTACTTCTACCGAAC | |
| | | | CGTCCGAGGGTAGCGCACCAGG | |
| | | | TACCTCTGAAAGCGCAACTCCT | |
| | | | GAGTCTGGCCCAGGTAGCGAAC | |
| | | | CTGCTACCTCCGGCTCTGAGAC | |
| | | | TCCAGGTACCTCTGAAAGCGCA | |
| | | | ACCCCGGAATCTGGTCCAGGTA | |
| | | | GCGAACCTGCAACCTCTGGCTC | |
| | | | TGAAACCCAGGTACCTCTGAA | |
| | | | AGCGCTACTCCTGAATCTGGCC | |
| | | | CAGGTACTTCTACTGAACCGTC | |
| | | | CGAGGGCAGCGCACCAGGTACT | |
| | | | TCTGAAAGCGCTACTCCTGAGT | |
| | | | CCGGCCCAGGTAGCCCGGCTGG | |
| | | | CTCTCCGACTTCCACCGAGGAA | |
| | | | GGTAGCCCGGCTGGCTCTCCAA | |
| | | | CTTCTACTGAAGAAGGTAGCCC | |
| | | | GGCAGGCTCTCCGACCTCTACT | |
| | | | GAGGAAGGTACTTCTGAAAGCG | |
| | | | CAACCCCGGAGTCCGGCCCAGG | |
| | | | TACCTCTACCGAACCGTCTGAG | |
| | | | GGCAGCGCACCAGGTACCTCTG | |
| | | | AAAGCGCAACTCCTGAGTCTGG | |
| | | | CCCAGGTAGCGAACCTGCTACC | |
| | | | TCCGGCTCTGAGACTCCAGGTA | |
| | | | CCTCTGAAAGCGCAACCCCGGA | |
| | | | ATCTGGTCCAGGTAGCGAACCT | |
| | | | GCAACCTCTGGCTCTGAAACCC | |
| | | | CAGGTACCTCTGAAAGCGCTAC | |
| | | | TCCTGAATCTGGCCCAGGTACT | |
| | | | TCTACTGAACCGTCCGAGGGCA | |
| | | | GCGCACCAGGTAGCCCTGCTGG | |
| | | | CTCTCCAACCTCCACCGAAGAA | |
| | | | GGTACCTCTGAAAGCGCAACCC | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | CTGAATCCGGCCCAGGTAGCGA ACCGGCAACCTCCGGTTCTGAA ACCCCAGGTACTTCTGAAAGCG CTACTCCTGAGTCCGGCCCAGG TAGCCCGGCTGGCTCTCCGACT TCCACCGAGGAAGGTAGCCCGG CTGGCTCTCCAACTTCTACTGA AGAAGGTACTTCTACCGAACCT TCCGAGGGCAGCGCACCAGGTA CTTCTGAAAGCGCTACCCCTGA GTCCGGCCCAGGTACTTCTGAA AGCGCTACTCCTGAATCCGGTC CAGGTACTTCTGAAAGCGCTAC CCCGGAATCTGGCCCAGGTAGC GAACCGGCTACTTCTGGTTCTG AAACCCCAGGTAGCGAACCGGC TACCTCCGGTTCTGAAACTCCA GGTAGCCCAGCAGGCTCTCCGA CTTCCACTGAGGAAGGTACTTC TACTGAACCTTCCGAAGGCAGC GCACCAGGTACCTCTACTGAAC CTTCTGAGGGCAGCGCTCCAGG TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCA | |
| FVII-Kallikrein-AE288 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG SPFRSTGGGTSES ATPESGPGSEPATS GSETPGTSESATPE SGPGSEPATSGSET PGTSESATPESGPG TSTEPSEGSAPGSP AGSPTSTEEGTSES ATPESGPGSEPATS GSETPGTSESATPE SGPGSPAGSPTSTE EGSPAGSPTSTEEG TSTEPSEGSAPGTS ESATPESGPGTSES ATPESGPGTSESAT | 718 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGGGACTCCCCAA ATATCACGGAGTACATGTTCTG | 719 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | PESGPGSEPATSGS ETPGSEPATSGSET PGSPAGSPTSTEEG TSTEPSEGSAPGTS TEPSEGSAPGSEPA TSGSETPGTSESAT PESGPGTSTEPSEG SAP | | TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGT0GGTGGT ACCTCTGAAAGCGCAACTCCTG AGTCTGGCCCAGGTAGCGAACC TGCTACCTCCGGCTCTGAGACT CCAGGTACCTCTGAAAGCGCAA CCCCGGAATCTGGTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCAGGTAGC CCTGCTGGCTCTCCAACCTCCA CCGAAGAAGGTACCTCTGAAAG CGCAACCCCTGAATCCGGCCCA GGTAGCGAACCGGCAACCTCCG GTTCTGAAACCCAGGTACTTC TGAAAGCGCTACTCCTGAGTCC GGCCCAGGTAGCCCGGCTGGCT CTCCGACTTCCACCGAGGAAGG TAGCCCGGCTGGCTCTCCAACT TCTACTGAAGAAGGTACTTCTA CCGAACCTTCCGAGGGCAGCGC ACCAGGTACTTCTGAAAGCGCT ACCCCTGAGTCCGGCCCAGGTA CTTCTGAAAGCGCTACTCCTGA ATCCGGTCCAGGTACTTCTGAA AGCGCTACCCCGGAATCTGGCC CAGGTAGCGAACCGGCTACTTC TGGTTCTGAAACCCAGGTAGC GAACCGGCTACCTCCGGTTCTG AAACTCCAGGTAGCCCAGCAGG CTCTCCGACTTCCACTGAGGAA GGTACTTCTACTGAACCTTCCG AAGGCAGCGCACCAGGTACCTC TACTGAACTTCTGAGGGCAGC GCTCCAGGTAGCGAACCTGCAA CCTCTGGCTCTGAAACCCCAGG TACCTCTGAAAGCGCTACTCCT GAATCTGGCCCAGGTACTTCTA CTGAACCGTCCGAGGGCAGCGC ACCA | |
| FVII- Kallikrein- AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHPQV VLTDHVVPLCLPE RTFSERTLAFVRFS | 720 | GCCAACGCGTTCCTGGAGGAGC TACGGCCGGGCTCCCTGGAGAG GGAGTGCAAGGAGGAGCAGTG CTCCTTCGAGGAGGCCCGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG | 721 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | LVSGWGQLLDRG | | GGGGGCAAGGTGTGCCCCAAA | |
| | ATALELMVLNVPR | | GGGGAGTGTCCATGGCAGGTCC | |
| | LMTQDCLQQSRK | | TGTTGTTGGTGAATGGAGCTCA | |
| | VGDSPNITEYMFC | | GTTGTGTGGGGGGACCCTGATC | |
| | AGYSDGSKDSCKG | | AACACCATCTGGGTGGTCTCCG | |
| | DSGGPHATHYRGT | | CGGCCCACTGTTTCGACAAAAT | |
| | WYLTGIVSWGQG | | CAAGAACTGGAGGAACCTGATC | |
| | CATVGHFGVYTRV | | GCGGTGCTGGGCGAGCACGACC | |
| | SQYIEWLQKLMRS | | TCAGCGAGCACGACGGGGATG | |
| | EPRPGVLLRAPFPG | | AGCAGAGCCGGCGGGTGGCGC | |
| | SPFRSTGGGGSPA | | AGGTCATCATCCCCAGCACGTA | |
| | GSPTSTEEGTSESA | | CGTCCCGGGCACCACCAACCAC | |
| | TPESGPGTSTEPSE | | GACATCGCGCTGCTCCGCCTGC | |
| | GSAPGSPAGSPTST | | ACCAGCCCGTGGTCCTCACTGA | |
| | EEGTSTEPSEGSAP | | CCATGTGGTGCCCCTCTGCCTG | |
| | GTSTEPSEGSAPGT | | CCCGAACGGACGTTCTCTGAGA | |
| | SESATPESGPGSEP | | GGACGCTGGCCTTCGTGCGCTT | |
| | ATSGSETPGSEPAT | | CTCATTGGTCAGCGGCTGGGGC | |
| | SGSETPGSPAGSPT | | CAGCTGCTGGACCGTGGCGCCA | |
| | STEEGTSESATPES | | CGGCCCTGGAGCTCATGGTCCT | |
| | GPGTSTEPSEGSAP | | CAACGTGCCCCGGCTGATGACC | |
| | GTSTEPSEGSAPGS | | CAGGACTGCCTGCAGCAGTCAC | |
| | PAGSPTSTEEGTST | | GGAAGGTGGGAGACTCCCCAA | |
| | EPSEGSAPGTSTEP | | ATATCACGGAGTACATGTTCTG | |
| | SEGSAPGTSESATP | | TGCCGGCTACTCGGATGGCAGC | |
| | ESGPGTSTEPSEGS | | AAGGACTCCTGCAAGGGGGAC | |
| | APGTSESATPESGP | | AGTGGAGGCCCACATGCCACCC | |
| | GSEPATSGSETPGT | | ACTACCGGGGCACGTGGTACCT | |
| | STEPSEGSAPGTST | | GACGGGCATCGTCAGCTGGGGC | |
| | EPSEGSAPGTSESA | | CAGGGCTGCGCAACCGTGGGCC | |
| | TPESGPGTSTESATP | | ACTTTGGGGTGTACACCAGGGT | |
| | ESGPGSPAGSPTST | | CTCCCAGTACATCGAGTGGCTG | |
| | EEGTSESATPESGP | | CAAAAGCTCATGCGCTCAGAGC | |
| | GSEPATSGSETPGT | | CACGCCCAGGAGTCCTCCTGCG | |
| | SESATPESGPGTST | | AGCCCCATTTCCCGGT0GGTGGT | |
| | EPSEGSAPGTSTEP | | AGCCCGGCTGGCTCTCCTACCT | |
| | SEGSAPGTSTEPSE | | CTACTGAGGAAGGTACTTCTGA | |
| | GSAPGTSTEPSEGS | | AAGCGCTACTCCTGAGTCTGGT | |
| | APGTSTEPSEGSAP | | CCAGGTACCTCTACTGAACCGT | |
| | GTSTEPSEGSAPGS | | CCGAAGGTAGCGCTCCAGGTAG | |
| | PAGSPTSTEEGTST | | CCCAGCAGGCTCTCCGACTTCC | |
| | EPSEGSAPGTSESA | | ACTGAGGAAGGTACTTCTACTG | |
| | TPESGPGSEPATSG | | AACCTTCCGAAGGCAGCGCACC | |
| | SETPGTSESATPES | | AGGTACCTCTACTGAACCTTCT | |
| | GPGSEPATSGSETP | | GAGGGCAGCGCTCCAGGTACTT | |
| | GTSESATPESGPGT | | CTGAAAGCGCTACCCCGGAATC | |
| | STEPSEGSAPGTSE | | TGGCCCAGGTAGCGAACCGGCT | |
| | SATPESGPGSPAGS | | ACTTCTGGTTCTGAAACCCCAG | |
| | PTSTEEGSPAGSPT | | GTAGCGAACCGGCTACCTCCGG | |
| | STEEGSPAGSPTST | | TTCTGAAACTCCAGGTAGCCCG | |
| | EEGTSESATPESGP | | GCAGGCTCTCCGACCTCTACTG | |
| | GTSTEPSEGSAPGT | | AGGAAGGTACTTCTGAAAGCGC | |
| | SESATPESGPGSEP | | AACCCCGGAGTCCGGCCCAGGT | |
| | ATSGSETPGTSESA | | ACCTCTACCGAACCGTCTGAGG | |
| | TPESGPGSEPATSG | | GCAGCGCACCAGGTACTTCTAC | |
| | SETPGTSESATPES | | CGAACCGTCCGAGGGTAGCGCA | |
| | GPGTSTEPSEGSAP | | CCAGGTAGCCCAGCAGGTTCTC | |
| | GSPAGSPTSTEEGT | | CTACCTCCACCGAGGAAGGTAC | |
| | SESATPESGPGSEP | | TTCTACCGAACCGTCCGAGGGT | |
| | ATSGSETPGTSESA | | AGCGCACCAGGTACCTCTACTG | |
| | TPESGPGSPAGSPT | | AACCTTCTGAGGGCAGCGCTCC | |
| | STEEGSPAGSPTST | | AGGTACTTCTGAAAGCGCTACC | |
| | EEGTSTEPSEGSAP | | CCGGAGTCCGGTCCAGGTACTT | |
| | GTSESATPESGPGT | | CTACTGAACCGTCCGAAGGTAG | |
| | SESATPESGPGTSE | | CGCACCAGGTACTTCTGAAAGC | |
| | SATPESGPGSEPAT | | GCAACCCCTGAATCCGGTCCAG | |
| | SGSETPGSEPATSG | | GTAGCGAACCGGCTACTTCTGG | |
| | SETPGSPAGSPTST | | CTCTGAGACTCCAGGTACTTCT | |
| | EEGTSTEPSEGSAP | | ACCGAACCGTCCGAAGGTAGCG | |
| | GTSTEPSEGSAPGS | | CACCAGGTACTTCTACTGAACC | |
| | EPATSGSETPGTSE | | GTCTGAAGGTAGCGCACCAGGT | |
| | SATPESGPGTSTEP | | ACTTCTGAAAGCGCAACCCCGG | |
| | SEGSAP | | AATCCGGCCCAGGTACCTCTGA | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | AAGCGCAACCCCGGAGTCCGGC CCAGGTAGCCCTGCTGGCTCTC CAACCTCCACCGAAGAAGGTAC CTCTGAAAGCGCAACCCCTGAA TCCGGCCCAGGTAGCGAACCGG CAACCTCCGGTTCTGAAACCCC AGGTACCTCTGAAAGCGCTACT CCGGAGTCTGGCCCAGGTACCT CTACTGAACCGTCTGAGGGTAG CGCTCCAGGTACTTCTACTGAA CCGTCCGAAGGTAGCGCACCAG GTACTTCTACCGAACCGTCCGA AGGCAGCGCTCCAGGTACCTCT ACTGAACCTTCCGAGGGCAGCG CTCCAGGTACCTCTACCGAACC TTCTGAAGGTAGCGCACCAGGT ACTTCTACCGAACCGTCCGAGG GTAGCGCACCAGGTAGCCCAGC AGGTTCTCCTACCTCCACCGAG GAAGGTACTTCTACCGAACCGT CCGAGGGTAGCGCACCAGGTAC CTCTGAAAGCGCAACTCCTGAG TCTGGCCCAGGTAGCGAACCTG CTACCTCCGGCTCTGAGACTCC AGGTACCTCTGAAAGCGCAACC CCGGAATCTGGTCCAGGTAGCG AACCTGCAACCTCTGGCTCTGA AACCCCAGGTACCTCTGAAAGC GCTACTCCTGAATCTGGCCCAG GTACTTCTACTGAACCGTCCGA GGGCAGCGCACCAGGTACTTCT GAAAGCGCTACTCCTGAGTCCG GCCCAGGTAGCCCGGCTGGCTC TCCGACTTCCACCGAGGAAGGT AGCCCGGCTGGCTCTCCAACTT CTACTGAAGAAGGTAGCCCGGC AGGCTCTCCGACCTCTACTGAG GAAGGTACTTCTGAAAGCGCAA CCCCGGAGTCCGGCCCAGGTAC CTCTACCGAACCGTCTGAGGGC AGCGCACCAGGTACCTCTGAAA GCGCAACTCCTGAGTCTGGCCC AGGTAGCGAACCTGCTACCTCC GGCTCTGAGACTCCAGGTACCT CTGAAAGCGCAACCCCGGAATC TGGTCCAGGTAGCGAACCTGCA ACCTCTGGCTCTGAAACCCCAG GTACCTCTGAAAGCGCTACTCC TGAATCTGGCCCAGGTACTTCT ACTGAACCGTCCGAGGGCAGCG CACCAGGTAGCCCTGCTGGCTC TCCAACCTCCACCGAAGAAGGT ACCTCTGAAAGCGCAACCCCTG AATCCGGCCCAGGTAGCGAACC GGCAACCTCCGGTTCTGAAACC CCAGGTACTTCTGAAAGCGCTA CTCCTGAGTCCGGCCCAGGTAG CCCGGCTGGCTCTCCGACTTCC ACCGAGGAAGGTAGCCCGGCTG GCTCTCCAACTTCTACTGAAGA AGGTACTTCTACCGAACCTTCC GAGGGCAGCGCACCAGGTACTT CTGAAAGCGCTACCCCTGAGTC CGGCCCAGGTACTTCTGAAAGC GCTACTCCTGAATCCGGTCCAG GTACTTCTGAAAGCGCTACCCC GGAATCTGGCCCAGGTAGCGAA CCGGCTACTTCTGGTTCTGAAA CCCCAGGTAGCGAACCGGCTAC CTCCGGTTCTGAAACTCCAGGT AGCCCAGCAGGCTCTCCGACTT CCACTGAGGAAGGTACTTCTAC TGAACCTTCCGAAGGCAGCGCA | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | CCAGGTACCTCTACTGAACCTT CTGAGGGCAGCGCTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCA | |
| FIX-Kallikrein-AE288 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGS PFRSTGGGGTSESA TPESGPGSEPATSG SETPGTSESATPES GPGSEPATSGSETP GTSESATPESGPGT STEPSEGSAPGSPA GSPTSTEEGTSESA TPESGPGSEPATSG SETPGTSESATPES GPGSPAGSPTSTEE GSPAGSPTSTEEGT STEPSEGSAPGTSE SATPESGPGTSESA TPESGPGTSESATP ESGPGSEPATSGSE TPGSEPATSGSETP GSPAGSPTSTEEGT STEPSEGSAPGTST EPSEGSAPGSEPAT SGSETPGTSESATP ESGPGTSTEPSEGS AP | 722 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGT0GGT GGTACCTCTGAAAGCGCAACTC CTGAGTCTGGCCCAGGTAGCGA ACCTGCTACCTCCGGCTCTGAG ACTCCAGGTACCTCTGAAAGCG CAACCCCGGAATCTGGTCCAGG TAGCGAACCTGCAACCTCTGGC TCTGAAACCCCAGGTACCTCTG AAAGCGCTACTCCTGAATCTGG | 723 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | CCCAGGTACTTCTACTGAACCG TCCGAGGGCAGCGCACCAGGTA GCCCTGCTGGCTCTCCAACCTC CACCGAAGAAGGTACCTCTGAA AGCGCAACCCCTGAATCCGGCC CAGGTAGCGAACCGGCAACCTC CGGTTCTGAAACCCCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTACTTC TACCGAACCTTCCGAGGGCAGC GCACCAGGTACTTCTGAAAGCG CTACCCCTGAGTCCGGCCCAGG TACTTCTGAAAGCGCTACTCCT GAATCCGGTCCAGGTACTTCTG AAAGCGCTACCCCGGAATCTGG CCCAGGTAGCGAACCGGCTACT TCTGGTTCTGAAACCCCAGGTA GCGAACCGGCTACCTCCGGTTC TGAAACTCCAGGTAGCCCAGCA GGCTCTCCGACTTCCACTGAGG AAGGTACTTCTACTGAACCTTC CGAAGGCAGCGCACCAGGTACC TCTACTGAACCTTCTGAGGGCA GCGCTCCAGGTAGCGAACCTGC AACCTCTGGCTCTGAAACCCCA GGTACCTCTGAAAGCGCTACTC CTGAATCTGGCCCAGGTACTTC TACTGAACCGTCCGAGGGCAGC GCACCA | |
| FIX-Kallikrein-AE864 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDPTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGS PFRSTGGGSPAG SPTSTEEGTSESAT PESGPGTSTEPSEG SAPGSPAGSPTSTE EGTSTEPSEGSAPG TSTEPSEGSAPGTS ESATPESGPGSEPA TSGSETPGSEPATS | 724 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA | 725 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | GSETPGSPAGSPTS | | ATACACGAACATCTTCCTCAAA | |
| | TEEGTSESATPESG | | TTTGGATCTGGCTATGTAAGTG | |
| | PGTSTEPSEGSAPG | | GCTGGGGAAGAGTCTTCCACAA | |
| | TSTEPSEGSAPGSP | | AGGGAGATCAGCTTTAGTTCTT | |
| | AGSPTSTEEGTSTE | | CAGTACCTTAGAGTTCCACTTG | |
| | PSEGSAPGTSTEPS | | TTGACCGAGCCACATGTCTTCG | |
| | EGSAPGTSESATPE | | ATCTACAAAGTTCACCATCTAT | |
| | SGPGTSTEPSEGSA | | AACAACATGTTCTGTGCTGGCT | |
| | PGTSESATPESGPG | | TCCATGAAGGAGGTAGAGATTC | |
| | SEPATSGSETPGTS | | ATGTCAAGGAGATAGTGGGGG | |
| | TEPSEGSAPGTSTE | | ACCCCATGTTACTGAAGTGGAA | |
| | PSEGSAPGTSESAT | | GGGACCAGTTTCTTAACTGGAA | |
| | PESGPGTSESATPE | | TTATTAGCTGGGGTGAAGAGTG | |
| | SGPGSPAGSPTSTE | | TGCAATGAAAGGCAAATATGGA | |
| | EGTSESATPESGPG | | ATATATACCAAGGTATCCCGGT | |
| | SEPATSGSETPGTS | | ATGTCAACTGGATTAAGGAAAA | |
| | ESATPESGPGTSTE | | AACAAAGCTCACTGGGGT0GGT | |
| | PSEGSAPGTSTEPS | | GGTAGCCCGGCTGGCTCTCCTA | |
| | EGSAPGTSTEPSEG | | CCTCTACTGAGGAAGGTACTTC | |
| | SAPGTSTEPSEGSA | | TGAAAGCGCTACTCCTGAGTCT | |
| | PGTSTEPSEGSAPG | | GGTCCAGGTACCTCTACTGAAC | |
| | TSTEPSEGSAPGSP | | CGTCCGAAGGTAGCGCTCCAGG | |
| | AGSPTSTEEGTSTE | | TAGCCCAGCAGGCTCTCCGACT | |
| | PSEGSAPGTSESAT | | TCCACTGAGGAAGGTACTTCTA | |
| | PESGPGSEPATSGS | | CTGAACCTTCCGAAGGCAGCGC | |
| | ETPGTSESATPESG | | ACCAGGTACCTCTACTGAACCT | |
| | PGSEPATSGSETPG | | TCTGAGGGCAGCGCTCCAGGTA | |
| | TSESATPESGPGTS | | CTTCTGAAAGCGCTACCCCGGA | |
| | TEPSEGSAPGTSES | | ATCTGGCCCAGGTAGCGAACCG | |
| | ATPESGPGSPAGSP | | GCTACTTCTGGTTCTGAAACCC | |
| | TSTEEGSPAGSPTS | | CAGGTAGCGAACCGGCTACCTC | |
| | TEEGSPAGSPTSTE | | CGGTTCTGAAACTCCAGGTAGC | |
| | EGTSESATPESGPG | | CCGGCAGGCTCTCCGACCTCTA | |
| | TSTEPSEGSAPGTS | | CTGAGGAAGGTACTTCTGAAAG | |
| | ESATPESGPGSEPA | | CGCAACCCCGGAGTCCGGCCCA | |
| | TSGSETPGTSESAT | | GGTACCTCTACCGAACCGTCTG | |
| | PESGPGSEPATSGS | | AGGGCAGCGCACCAGGTACTTC | |
| | ETPGTSESATPESG | | TACCGAACCGTCCGAGGGTAGC | |
| | PGTSTEPSEGSAPG | | GCACCAGGTAGCCCAGCAGGTT | |
| | SPAGSPTSTEEGTS | | CTCCTACCTCCACCGAGGAAGG | |
| | ESATPESGPGSEPA | | TACTTCTACCGAACCGTCCGAG | |
| | TSGSETPGTSESAT | | GGTAGCGCACCAGGTACCTCTA | |
| | PESGPGSPAGSPTS | | CTGAACCTTCTGAGGGCAGCGC | |
| | TEEGSPAGSPTSTE | | TCCAGGTACTTCTGAAAGCGCT | |
| | EGTSTEPSEGSAPG | | ACCCCGGAGTCCGGTCCAGGTA | |
| | TSESATPESGPGTS | | CTTCTACTGAACCGTCCGAAGG | |
| | ESATPESGPGTSES | | TAGCGCACCAGGTACTTCTGAA | |
| | ATPESGPGSEPATS | | AGCGCAACCCCTGAATCCGGTC | |
| | GSETPGSEPATSGS | | CAGGTAGCGAACCGGCTACTTC | |
| | ETPGSPAGSPTSTE | | TGGCTCTGAGACTCCAGGTACT | |
| | EGTSTEPSEGSAPG | | TCTACCGAACCGTCCGAAGGTA | |
| | TSTEPSEGSAPGSE | | GCGCACCAGGTACTTCTACTGA | |
| | PATSGSETPGTSES | | ACCGTCTGAAGGTAGCGCACCA | |
| | ATPESGPGTSTEPS | | GGTACTTCTGAAAGCGCAACCC | |
| | EGSAP | | CGGAATCCGGCCCAGGTACCTC | |
| | | | TGAAAGCGCAACCCCGGAGTCC | |
| | | | GGCCCAGGTAGCCCTGCTGGCT | |
| | | | CTCCAACCTCCACCGAAGAAGG | |
| | | | TACCTCTGAAAGCGCAACCCCT | |
| | | | GAATCCGGCCCAGGTAGCGAAC | |
| | | | CGGCAACCTCCGGTTCTGAAAC | |
| | | | CCCAGGTACCTCTGAAAGCGCT | |
| | | | ACTCCGGAGTCTGGCCCAGGTA | |
| | | | CCTCTACTGAACCGTCTGAGGG | |
| | | | TAGCGCTCCAGGTACTTCTACT | |
| | | | GAACCGTCCGAAGGTAGCGCAC | |
| | | | CAGGTACTTCTACCGAACCGTC | |
| | | | CGAAGGCAGCGCTCCAGGTACC | |
| | | | TCTACTGAACCTTCCGAGGGCA | |
| | | | GCGCTCCAGGTACCTCTACCGA | |
| | | | ACCTTCTGAAGGTAGCGCACCA | |
| | | | GGTACTTCTACCGAACCGTCCG | |
| | | | AGGGTAGCGCACCAGGTAGCCC |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | AGCAGGTTCTCCTACCTCCACC GAGGAAGGTACTTCTACCGAAC CGTCCGAGGGTAGCGCACCAGG TACCTCTGAAAGCGCAACTCCT GAGTCTGGCCCAGGTAGCGAAC CTGCTACCTCCGGCTCTGAGAC TCCAGGTACCTCTGAAAGCGCA ACCCCGGAATCTGGTCCAGGTA GCGAACCTGCAACCTCTGGCTC TGAAACCCCAGGTACCTCTGAA AGCGCTACTCCTGAATCTGGCC CAGGTACTTCTACTGAACCGTC CGAGGGCAGCGCACCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTAGCCC GGCAGGCTCTCCGACCTCTACT GAGGAAGGTACTTCTGAAAGCG CAACCCCGGAGTCCGGCCCAGG TACCTCTACCGAACCGTCTGAG GGCAGCGCACCAGGTACCTCTG AAAGCGCAACTCCTGAGTCTGG CCCAGGTAGCGAACCTGCTACC TCCGGCTCTGAGACTCCAGGTA CCTCTGAAAGCGCAACCCCGGA ATCTGGTCCAGGTAGCGAACCT GCAACCTCTGGCTCTGAAACCC CAGGTACCTCTGAAAGCGCTAC TCCTGAATCTGGCCCAGGTACT TCTACTGAACCGTCCGAGGGCA GCGCACCAGGTAGCCCTGCTGG CTCTCCAACCTCCACCGAAGAA GGTACCTCTGAAAGCGCAACCC CTGAATCCGGCCCAGGTAGCGA ACCGGCAACCTCCGGTTCTGAA ACCCCAGGTACTTCTGAAAGCG CTACTCCTGAGTCCGGCCCAGG TAGCCCGGCTGGCTCTCCGACT TCCACCGAGGAAGGTAGCCCGG CTGGCTCTCCAACTTCTACTGA AGAAGGTACTTCTACCGAACCT TCCGAGGGCAGCGCACCAGGTA CTTCTGAAAGCGCTACCCCTGA GTCCGGCCCAGGTACTTCTGAA AGCGCTACTCCTGAATCCGGTC CAGGTACTTCTGAAAGCGCTAC CCCGGAATCTGGCCCAGGTAGC GAACCGGCTACTTCTGGTTCTG AAAACCCCAGGTAGCGAACCGGC TACCTCCGGTTCTGAAACTCCA GGTAGCCCAGCAGGCTCTCCGA CTTCCACTGAGGAAGGTACTTC TACTGAACCTTCCGAAGGCAGC GCACCAGGTACCTCTACTGAAC CTTCTGAGGGCAGCGCTCCAGG TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCA | |
| FVII-FIIa-AE288 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE | 726 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC | 727 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG LTPRSLLVGGTSES ATPESGPGSEPATS GSETPGTSESATPE SGPGSEPATSGSET PGTSESATPESGPG TSTEPSEGSAPGSP AGSPTSTEEGTSES ATPESGPGSEPATS GSETPGTSESATPE SGPGSPAGSPTSTE EGSPAGSPTSTEEG TSTEPSEGSAPGTS ESATPESGPGTSES ATPESGPGTSESAT PESGPGSEPATSGS ETPGSEPATSGSET PGSPAGSPTSTEEG TSTEPSEGSAPGTS TEPSEGSAPGSEPA TSGSETPGTSESAT PESGPGTSTEPSEG SAP | | TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGGTGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGT0GGTGGT ACCTCTGAAAGCGCAACTCCTG AGTCTGGCCCAGGTAGCGAACC TGCTACCTCCGGCTCTGAGACT CCAGGTACCTCTGAAAGCGCAA CCCCGGAATCTGGTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCAGGTAGC CCTGCTGGCTCTCCAACCTCCA CCGAAGAAGGTACCTCTGAAAG CGCAACCCCTGAATCCGGCCCA GGTAGCGAACCGGCAACCTCCG GTTCTGAAACCCCAGGTACTTC TGAAAGCGCTACTCCTGAGTCC GGCCCAGGTAGCCCGGCTGGCT CTCCGACTTCCACCGAGGAAGG TAGCCCGGCTGGCTCTCCAACT TCTACTGAAGAAGGTACTTCTA CCGAACCTTCCGAGGGCAGCGC ACCAGGTACTTCTGAAAGCGCT ACCCCTGAGTCCGGCCCAGGTA CTTCTGAAAGCGCTACTCCTGA ATCCGGTCCAGGTACTTCTGAA AGCGCTACCCCGGAATCTGGCC CAGGTAGCGAACCGGCTACTTC | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | TGGTTCTGAAACCCCAGGTAGC GAACCGGCTACCTCCGGTTCTG AAACTCCAGGTAGCCCAGCAGG CTCTCCGACTTCCACTGAGGAA GGTACTTCTACTGAACCTTCCG AAGGCAGCGCACCAGGTACCTC TACTGAACCTTCTGAGGGCAGC GCTCCAGGTAGCGAACCTGCAA CCTCTGGCTCTGAAACCCCAGG TACCTCTGAAAGCGCTACTCCT GAATCTGGCCCAGGTACTTCTA CTGAACCGTCCGAGGGCAGCGC ACCA | |
| FVII-FIIa-AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG LTPRSLLVGGSPA GSPTSTEEGTSESA TPESGPGTSTEPSE GSAPGSPAGSPTST EEGTSTEPSEGSAP GTSTEPSEGSAPGT SESATPESGPGSEP ATSGSETPGSEPAT SGSETPGSPAGSPT STEEGTSESATPES GPGTSTEPSEGSAP GTSTEPSEGSAPGS PAGSPTSTEEGTST EPSEGSAPGTSTEP SEGSAPGTSESATP ESGPGTSTEPSEGS APGTSESATPESGP GSEPATSGSETPGT STEPSEGSAPGTST EPSEGSAPGTSESA TPESGPGTSESATP ESGPGSPAGSPTST EEGTSESATPESGP GSEPATSGSETPGT SESATPESGPGTST EPSEGSAPGTSTEP SEGSAPGTSTEPSE GSAPGTSTEPSEGS | 728 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCGACGGGGT GTCCTGCACACCCACAGTTGAA TATCCATGTGGAAAAATACCTA TTCTAGAAAAAAGAAATGCCAG CAAACCCCAAGGCCGAATTGTG GGGGCAAGGTGTGCCCCAAA GGGGAGTGTCCATGGCAGGTCC TGTTGTTGGTGAATGGAGCTCA GTTGTGTGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGT0GGTGGT AGCCCGGCTGGCTCTCCTACCT CTACTGAGGAAGGTACTTCTGA AAGCGCTACTCCTGAGTCTGGT | 729 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | APGTSTEPSEGSAP | | CCAGGTACCTCTACTGAACCGT | |
| | GTSTEPSEGSAPGS | | CCGAAGGTAGCGCTCCAGGTAG | |
| | PAGSPTSTEEGTST | | CCCAGCAGGCTCTCCGACTTCC | |
| | EPSEGSAPGTSESA | | ACTGAGGAAGGTACTTCTACTG | |
| | TPESGPGSEPATSG | | AACCTTCCGAAGGCAGCGCACC | |
| | SETPGTSESATPES | | AGGTACCTCTACTGAACCTTCT | |
| | GPGSEPATSGSETP | | GAGGGCAGCGCTCCAGGTACTT | |
| | GTSESATPESGPGT | | CTGAAAGCGCTACCCCGGAATC | |
| | STEPSEGSAPGTSE | | TGGCCCAGGTAGCGAACCGGCT | |
| | SATPESGPGSPAGS | | ACTTCTGGTTCTGAAACCCCAG | |
| | PTSTEEGSPAGSPT | | GTAGCGAACCGGCTACCTCCGG | |
| | STEEGSPAGSPTST | | TTCTGAAACTCCAGGTAGCCCG | |
| | EEGTSESATPESGP | | GCAGGCTCTCCGACCTCTACTG | |
| | GTSTEPSEGSAPGT | | AGGAAGGTACTTCTGAAAGCGC | |
| | SESATPESGPGSEP | | AACCCCGGAGTCCGGCCCAGGT | |
| | ATSGSETPGTSESA | | ACCTCTACCGAACCGTCTGAGG | |
| | TPESGPGSEPATSG | | GCAGCGCACCAGGTACTTCTAC | |
| | SETPGTSESATPES | | CGAACCGTCCGAGGGTAGCGCA | |
| | GPGTSTEPSEGSAP | | CCAGGTAGCCCAGCAGGTTCTC | |
| | GSPAGSPTSTEEGT | | CTACCTCCACCGAGGAAGGTAC | |
| | SESATPESGPGSEP | | TTCTACCGAACCGTCCGAGGGT | |
| | ATSGSETPGTSESA | | AGCGCACCAGGTACCTCTACTG | |
| | TPESGPGSPAGSPT | | AACCTTCTGAGGGCAGCGCTCC | |
| | STEEGSPAGSPTST | | AGGTACTTCTGAAAGCGCTACC | |
| | EEGTSTEPSEGSAP | | CCGGAGTCCGGTCCAGGTACTT | |
| | GTSESATPESGPGT | | CTACTGAACCGTCCGAAGGTAG | |
| | SESATPESGPGTSE | | CGCACCAGGTACTTCTGAAAGC | |
| | SATPESGPGSEPAT | | GCAACCCCTGAATCCGGTCCAG | |
| | SGSETPGSEPATSG | | GTAGCGAACCGGCTACTTCTGG | |
| | SETPGSPAGSPTST | | CTCTGAGACTCCAGGTACTTCT | |
| | EEGTSTEPSEGSAP | | ACCGAACCGTCCGAAGGTAGCG | |
| | GTSTEPSEGSAPGS | | CACCAGGTACTTCTACTGAACC | |
| | EPATSGSETPGTSE | | GTCTGAAGGTAGCGCACCAGGT | |
| | SATPESGPGTSTEP | | ACTTCTGAAAGCGCAACCCCGG | |
| | SEGSAP | | AATCCGGCCCAGGTACCTCTGA | |
| | | | AAGCGCAACCCCGGAGTCCGGC | |
| | | | CCAGGTAGCCCTGCTGGCTCTC | |
| | | | CAACCTCCACCGAAGAAGGTAC | |
| | | | CTCTGAAAGCGCAACCCCTGAA | |
| | | | TCCGGCCCAGGTAGCGAACCGG | |
| | | | CAACCTCCGGTTCTGAAACCCC | |
| | | | AGGTACCTCTGAAAGCGCTACT | |
| | | | CCGGAGTCTGGCCCAGGTACCT | |
| | | | CTACTGAACCGTCTGAGGGTAG | |
| | | | CGCTCCAGGTACTTCTACTGAA | |
| | | | CCGTCCGAAGGTAGCGCACCAG | |
| | | | GTACTTCTACCGAACCGTCCGA | |
| | | | AGGCAGCGCTCCAGGTACCTCT | |
| | | | ACTGAACCTTCCGAGGGCAGCG | |
| | | | CTCCAGGTACCTCTACCGAACC | |
| | | | TTCTGAAGGTAGCGCACCAGGT | |
| | | | ACTTCTACCGAACCGTCCGAGG | |
| | | | GTAGCGCACCAGGTAGCCCAGC | |
| | | | AGGTTCTCCTACCTCCACCGAG | |
| | | | GAAGGTACTTCTACCGAACCGT | |
| | | | CCGAGGGTAGCGCACCAGGTAC | |
| | | | CTCTGAAAGCGCAACTCCTGAG | |
| | | | TCTGGCCCAGGTAGCGAACCTG | |
| | | | CTACCTCCGGCTCTGAGACTCC | |
| | | | AGGTACCTCTGAAAGCGCAACC | |
| | | | CCGGAATCTGGTCCAGGTAGCG | |
| | | | AACCTGCAACCTCTGGCTCTGA | |
| | | | AACCCCAGGTACCTCTGAAAGC | |
| | | | GCTACTCCTGAATCTGGCCCAG | |
| | | | GTACTTCTACTGAACCGTCCGA | |
| | | | GGGCAGCGCACCAGGTACTTCT | |
| | | | GAAAGCGCTACTCCTGAGTCCG | |
| | | | GCCCAGGTAGCCCGGCTGGCTC | |
| | | | TCCGACTTCCACCGAGGAAGGT | |
| | | | AGCCCGGCTGGCTCTCCAACTT | |
| | | | CTACTGAAGAAGGTAGCCCGGC | |
| | | | AGGCTCTCCGACCTCTACTGAG | |
| | | | GAAGGTACTTCTGAAAGCGCAA | |

| CFXTEN Name* | Amino Acid Sequence | SEQ ID NO: | DNA Nucleotide Sequence | SEQ ID NO: |
|---|---|---|---|---|
| | | | CCCCGGAGTCCGGCCCAGGTAC CTCTACCGAACCGTCTGAGGGC AGCGCACCAGGTACCTCTGAAA GCGCAACTCCTGAGTCTGGCCC AGGTAGCGAACCTGCTACCTCC GGCTCTGAGACTCCAGGTACCT CTGAAAGCGCAACCCCGGAATC TGGTCCAGGTAGCGAACCTGCA ACCTCTGGCTCTGAAACCCCAG GTACCTCTGAAAGCGCTACTCC TGAATCTGGCCCAGGTACTTCT ACTGAACCGTCCGAGGGCAGCG CACCAGGTAGCCCTGCTGGCTC TCCAACCTCCACCGAAGAAGGT ACCTCTGAAAGCGCAACCCCTG AATCCGGCCCAGGTAGCGAACC GGCAACCTCCGGTTCTGAAACC CCAGGTACTTCTGAAAGCGCTA CTCCTGAGTCCGGCCCAGGTAG CCCGGCTGGCTCTCCGACTTCC ACCGAGGAAGGTAGCCCGGCTG GCTCTCCAACTTCTACTGAAGA AGGTACTTCTACCGAACCTTCC GAGGGCAGCGCACCAGGTACTT CTGAAAGCGCTACCCCTGAGTC CGGCCCAGGTACTTCTGAAAGC GCTACTCCTGAATCCGGTCCAG GTACTTCTGAAAGCGCTACCCC GGAATCTGGCCCAGGTAGCGAA CCGGCTACTTCTGGTTCTGAAA CCCCAGGTAGCGAACCGGCTAC CTCCGGTTCTGAAACTCCAGGT AGCCCAGCAGGCTCTCCGACTT CCACTGAGGAAGGTACTTCTAC TGAACCTTCCGAAGGCAGCGCA CCAGGTACCTCTACTGAACCTT CTGAGGGCAGCGCTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCA | |
| FIX-FIIa-AE288 | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM | 730 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTGA ATGGTAAAGTTGATGCATTCTG TGGAGGCTCTATCGTTAATGAA AAATGGATTGTAACTGCTGCCC | 731 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | KGKYGIYTKVSRY VNWIKEKTKLTGL TPRSLLVGGTSESA TPESGPGSEPATSG SETPGTSESATPES GPGSEPATSGSETP GTSESATPESGPGT STEPSEGSAPGSPA GSPTSTEEGTSESA TPESGPGSEPATSG SETPGTSESATPES GPGSPAGSPTSTEE GSPAGSPTSTEEGT STEPSEGSAPGTSE SATPESGPGTSESA TPESGPGTSESATP ESGPGSEPATSGSE TPGSEPATSGSETP GSPAGSPTSTEEGT STEPSEGSAPGTST EPSEGSAPGSEPAT SGSETPGTSESATP ESGPGTSTEPSEGS AP | | ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGT0GGT GGTACCTCTGAAAGCGCAACTC CTGAGTCTGGCCCAGGTAGCGA ACCTGCTACCTCCGGCTCTGAG ACTCCAGGTACCTCTGAAAGCG CAACCCCGGAATCTGGTCCAGG TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCAGGTA GCCCTGCTGGCTCTCCAACCTC CACCGAAGAAGGTACCTCTGAA AGCGCAACCCCTGAATCCGGCC CAGGTAGCGAACCGGCAACCTC CGGTTCTGAAACCCCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTACTTC TACCGAACCTTCCGAGGGCAGC GCACCAGGTACTTCTGAAAGCG CTACCCCTGAGTCCGGCCCAGG TACTTCTGAAAGCGCTACTCCT GAATCCGGTCCAGGTACTTCTG AAAGCGCTACCCCGGAATCTGG CCCAGGTAGCGAACCGGCTACT TCTGGTTCTGAAACCCCAGGTA GCGAACCGGCTACCTCCGGTTC TGAAACTCCAGGTAGCCCAGCA GGCTCTCCGACTTCCACTGAGG AAGGTACTTCTACTGAACCTTC CGAAGGCAGCGCACCAGGTACC TCTACTGAACCTTCTGAGGGCA GCGCTCCAGGTAGCGAACCTGC AACCTCTGGCTCTGAAACCCCA GGTACCTCTGAAAGCGCTACTC CTGAATCTGGCCCAGGTACTTC TACTGAACCGTCCGAGGGCAGC GCACCA | |
| FIX-FIIa-AE864 | YNSGKLEEFVQGN LERECMEEKCSFE EAREVFENTERTT EFWKQYVDGDQC ESNPCLNGGSCKD | 732 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA | 733 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | DINSYECWCPFGF | | GAACAACTGAATTTTGGAAGCA | |
| | EGKNCELDVTCNI | | GTATGTTGATGGAGATCAGTGT | |
| | KNGRCEQFCKNSA | | GAGTCCAATCCATGTTTAAATG | |
| | DNKVVCSCTEGYR | | GCGGCAGTTGCAAGGATGACAT | |
| | LAENQKSCEPAVP | | TAATTCCTATGAATGTTGGTGTC | |
| | FPCGRVSVSQTSK | | CCTTTGGATTTGAAGGAAAGAA | |
| | LTRAETVFPDVDY | | CTGTGAATTAGATGTAACATGT | |
| | VNSTEAETILDNIT | | AACATTAAGAATGGCAGATGCG | |
| | QSTQSFNDFTRVV | | AGCAGTTTTGTAAAAATAGTGC | |
| | GGEDAKPGQFPW | | TGATAACAAGGTGGTTTGCTCC | |
| | QVVLNGKVDAFC | | TGTACTGAGGGATATCGACTTG | |
| | GGSIVNEKWIVTA | | CAGAAAACCAGAAGTCCTGTGA | |
| | AHCVETGVKITVV | | ACCAGCAGTGCCATTTCCATGT | |
| | AGEHNIEETEHTE | | GGAAGAGTTTCTGTTTCACAAA | |
| | QKRNVIRIIPHHNY | | CTTCTAAGCTCACCCGTGCTGA | |
| | NAAINKYNHDIAL | | GACTGTTTTTCCTGATGTGGACT | |
| | LELDEPLVLNSYV | | ATGTAAATTCTACTGAAGCTGA | |
| | TPICIADKEYTNIFL | | AACCATTTTGGATAACATCACT | |
| | KFGSGYVSGWGR | | CAAAGCACCCAATCATTTAATG | |
| | VFHKGRSALVLQY | | ACTTCACTCGGGTTGTTGGTGG | |
| | LRVPLVDRATCLR | | AGAAGATGCCAAACCAGGTCA | |
| | STKFTIYNNMFCA | | ATTCCCTTGGCAGGTTGTTTTGA | |
| | GPHEGGRDSCQGD | | ATGGTAAAGTTGATGCATTCTG | |
| | SGGPHVTEVEGTS | | TGGAGGCTCTATCGTTAATGAA | |
| | FLTGIISWGEECAM | | AAATGGATTGTAACTGCTGCCC | |
| | KGKYGIYTKVSRY | | ACTGTGTTGAAACTGGTGTTAA | |
| | VNWIKEKTKLTGL | | AATTACAGTTGTCGCAGGTGAA | |
| | TPRSLLVGGSPAGS | | CATAATATTGAGGAGACAGAAC | |
| | PTSTEEGTSESATP | | ATACAGAGCAAAAGCGAAATG | |
| | ESGPGTSTEPSEGS | | TGATTCGAATTATTCCTCACCAC | |
| | APGSPAGSPTSTEE | | AACTACAATGCAGCTATTAATA | |
| | GTSTEPSEGSAPGT | | AGTACAACCATGACATTGCCCT | |
| | STEPSEGSAPGTSE | | TCTGGAACTGGACGAACCCTTA | |
| | SATPESGPGSEPAT | | GTGCTAAACAGCTACGTTACAC | |
| | SGSETPGSEPATSG | | CTATTTGCATTGCTGACAAGGA | |
| | SETPGSPAGSPTST | | ATACACGAACATCTTCCTCAAA | |
| | EEGTSESATPESGP | | TTTGGATCTGGCTATGTAAGTG | |
| | GTSTEPSEGSAPGT | | GCTGGGGAAGAGTCTTCCACAA | |
| | STEPSEGSAPGSPA | | AGGGAGATCAGCTTTAGTTCTT | |
| | GSPTSTEEGTSTEP | | CAGTACCTTAGAGTTCCACTTG | |
| | SEGSAPGTSTEPSE | | TTGACCGAGCCACATGTCTTCG | |
| | GSAPGTSESATPES | | ATCTACAAAGTTCACCATCTAT | |
| | GPGTSTEPSEGSAP | | AACAACATGTTCTGTGCTGGCT | |
| | GTSESATPESGPGS | | TCCATGAAGGAGGTAGAGATTC | |
| | EPATSGSETPGTST | | ATGTCAAGGAGATAGTGGGGG | |
| | EPSEGSAPGTSTEP | | ACCCCATGTTACTGAAGTGGAA | |
| | SEGSAPGTSESATP | | GGGACCAGTTTCTTAACTGGAA | |
| | ESGPGTSESATPES | | TTATTAGCTGGGGTGAAGAGTG | |
| | GPGSPAGSPTSTEE | | TGCAATGAAAGGCAAATATGGA | |
| | GTSESATPESGPGS | | ATATATACCAAGGTATCCCGGT | |
| | EPATSGSETPGTSE | | ATGTCAACTGGATTAAGGAAAA | |
| | SATPESGPGTSTEP | | AACAAAGCTCACTGGGGT0GGT | |
| | SEGSAPGTSTEPSE | | GGTAGCCCGGCTGGCTCTCCTA | |
| | GSAPGTSTEPSEGS | | CCTCTACTGAGGAAGGTACTTC | |
| | APGTSTEPSEGSAP | | TGAAAGCGCTACTCCTGAGTCT | |
| | GTSTEPSEGSAPGT | | GGTCCAGGTACCTCTACTGAAC | |
| | STEPSEGSAPGSPA | | CGTCCGAAGGTAGCGCTCCAGG | |
| | GSPTSTEEGTSTEP | | TAGCCCAGCAGGCTCTCCGACT | |
| | SEGSAPGTSESATP | | TCCACTGAGGAAGGTACTTCTA | |
| | ESGPGSEPATSGSE | | CTGAACCTTCCGAAGGCAGCGC | |
| | TPGTSESATPESGP | | ACCAGGTACCTCTACTGAACCT | |
| | GSEPATSGSETPGT | | TCTGAGGGCAGCGCTCCAGGTA | |
| | SESATPESGPGTST | | CTTCTGAAAGCGCTACCCCGGA | |
| | EPSEGSAPGTSESA | | ATCTGGCCCAGGTAGCGAACCG | |
| | TPESGPGSPAGSPT | | GCTACTTCTGGTTCTGAAACCC | |
| | STEEGSPAGSPTST | | CAGGTAGCGAACCGGCTACCTC | |
| | EEGSPAGSPTSTEE | | CGGTTCTGAAACTCCAGGTAGC | |
| | GTSESATPESGPGT | | CCGGCAGGCTCTCCGACCTCTA | |
| | STEPSEGSAPGTSE | | CTGAGGAAGGTACTTCTGAAAG | |
| | SATPESGPGSEPAT | | CGCAACCCCGGAGTCCGGCCCA | |
| | SGSETPGTSESATP | | GGTACCTCTACCGAACCGTCTG | |
| | ESGPGSEPATSGSE | | AGGGCAGCGCACCAGGTACTTC | |
| | TPGTSESATPESGP | | TACCGAACCGTCCGAGGGTAGC | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | GTSTEPSEGSAPGS PAGSPTSTEEGTSE SATPESGPGSEPAT SGSETPGTSESATP ESGPGSPAGSPTST EEGSPAGSPTSTEE GTSTEPSEGSAPGT SESATPESGPGTSE SATPESGPGTSESA TPESGPGSEPATSG SETPGSEPATSGSE TPGSPAGSPTSTEE GTSTEPSEGSAPGT STEPSEGSAPGSEP ATSGSETPGTSESA TPESGPGTSTEPSE GSAP | | GCACCAGGTAGCCCAGCAGGTT CTCCTACCTCCACCGAGGAAGG TACTTCTACCGAACCGTCCGAG GGTAGCGCACCAGGTACCTCTA CTGAACCTTCTGAGGGCAGCGC TCCAGGTACTTCTGAAAGCGCT ACCCCGGAGTCCGGTCCAGGTA CTTCTACTGAACCGTCCGAAGG TAGCGCACCAGGTACTTCTGAA AGCGCAACCCCTGAATCCGGTC CAGGTAGCGAACCGGCTACTTC TGGCTCTGAGACTCCAGGTACT TCTACCGAACCGTCCGAAGGTA GCGCACCAGGTACTTCTACTGA ACCGTCTGAAGGTAGCGCACCA GGTACTTCTGAAAGCGCAACCC CGGAATCCGGCCCAGGTACCTC TGAAAGCGCAACCCCGGAGTCC GGCCCAGGTAGCCCTGCTGGCT CTCCAACCTCCACCGAAGAAGG TACCTCTGAAAGCGCAACCCCT GAATCCGGCCCAGGTAGCGAAC CGGCAACCTCCGGTTCTGAAAC CCCAGGTACCTCTGAAAGCGCT ACTCCGGAGTCTGGCCCAGGTA CCTCTACTGAACCGTCTGAGGG TAGCGCTCCAGGTACTTCTACT GAACCGTCCGAAGGTAGCGCAC CAGGTACTTCTACCGAACCGTC CGAAGGCAGCGCTCCAGGTACC TCTACTGAACCTTCCGAGGGCA GCGCTCCAGGTACCTCTACCGA ACCTTCTGAAGGTAGCGCACCA GGTACTTCTACCGAACCGTCCG AGGGTAGCGCACCAGGTAGCCC AGCAGGTTCTCCTACCTCCACC GAGGAAGGTACTTCTACCGAAC CGTCCGAGGGTAGCGCACCAGG TACCTCTGAAAGCGCAACTCCT GAGTCTGGCCCAGGTAGCGAAC CTGCTACCTCCGGCTCTGAGAC TCCAGGTACCTCTGAAAGCGCA ACCCCGGAATCTGGTCCAGGTA GCGAACCTGCAACCTCTGGCTC TGAAACCCCAGGTACCTCTGAA AGCGCTACTCCTGAATCTGGCC CAGGTACTTCTACTGAACCGTC CGAGGGCAGCGCACCAGGTACT TCTGAAAGCGCTACTCCTGAGT CCGGCCCAGGTAGCCCGGCTGG CTCTCCGACTTCCACCGAGGAA GGTAGCCCGGCTGGCTCTCCAA CTTCTACTGAAGAAGGTAGCCC GGCAGGCTCTCCGACCTCTACT GAGGAAGGTACTTCTGAAAGCG CAACCCCGGAGTCCGGCCCAGG TACCTCTACCGAACCGTCTGAG GGCAGCGCACCAGGTACCTCTG AAAGCGCAACTCCTGAGTCTGG CCCAGGTAGCGAACCTGCTACC TCCGGCTCTGAGACTCCAGGTA CCTCTGAAAGCGCAACCCCGGA ATCTGGTCCAGGTAGCGAACCT GCAACCTCTGGCTCTGAAACCC CAGGTACCTCTGAAAGCGCTAC TCCTGAATCTGGCCCAGGTACT TCTACTGAACCGTCCGAGGGCA GCGCACCAGGTAGCCCTGCTGG CTCTCCAACCTCCACCGAAGAA GGTACCTCTGAAAGCGCAACCC CTGAATCCGGCCCAGGTAGCGA ACCGGCAACCTCCGGTTCTGAA ACCCCAGGTACTTCTGAAAGCG | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | CTACTCCTGAGTCCGGCCCAGG TAGCCCGGCTGGCTCTCCGACT TCCACCGAGGAAGGTAGCCCGG CTGGCTCTCCAACTTCTACTGA AGAAGGTACTTCTACCGAACCT TCCGAGGGCAGCGCACCAGGTA CTTCTGAAAGCGCTACCCCTGA GTCCGGCCCAGGTACTTCTGAA AGCGCTACTCCTGAATCCGGTC CAGGTACTTCTGAAAGCGCTAC CCCGGAATCTGGCCCAGGTAGC GAACCGGCTACTTCTGGTTCTG AAACCCCAGGTAGCGAACCGGC TACCTCCGGTTCTGAAACTCCA GGTAGCCCAGCAGGCTCTCCGA CTTCCACTGAGGAAGGTACTTC TACTGAACCTTCCGAAGGCAGC GCACCAGGTACCTCTACTGAAC CTTCTGAGGGCAGCGCTCCAGG TAGCGAACCTGCAACCTCTGGC TCTGAAACCCCAGGTACCTCTG AAAGCGCTACTCCTGAATCTGG CCCAGGTACTTCTACTGAACCG TCCGAGGGCAGCGCACCA | |
| FVII-MMP-17-AE288 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG APLGLRLRGGTSE SATPESGPGSEPAT SGSETPGTSESATP ESGPGSEPATSGSE TPGTSESATPESGP GTSTEPSEGSAPGS PAGSPTSTEEGTSE SATPESGPGSEPAT SGSETPGTSESATP ESGPGSPAGSPTST EEGSPAGSPTSTEE GTSTEPSEGSAPGT SESATPESGPGTSE SATPESGPGTSESA TPESGPGSEPATSG SETPGSEPATSGSE TPGSPAGSPTSTEE | 734 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCCACATGCCACC | 735 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | GTSTEPSEGSAPGT STEPSEGSAPGSEP ATSGSETPGTSESA TPESGPGTSTEPSE GSAP | | ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGT0GGTGGT ACCTCTGAAAGCGCAACTCCTG AGTCTGGCCCAGGTAGCGAACC TGCTACCTCCGGCTCTGAGACT CCAGGTACCTCTGAAAGCGCAA CCCCGGAATCTGGTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCAGGTAGC CCTGCTGGCTCTCCAACCTCCA CCGAAGAAGGTACCTCTGAAAG CGCAACCCCTGAATCCGGCCCA GGTAGCGAACCGGCAACCTCCG GTTCTGAAACCCCAGGTACTTC TGAAAGCGCTACTCCTGAGTCC GGCCCAGGTAGCCCGGCTGGCT CTCCGACTTCCACCGAGGAAGG TAGCCCGGCTGGCTCTCCAACT TCTACTGAAGAAGGTACTTCTA CCGAACCTTCCGAGGGCAGCGC ACCAGGTACTTCTGAAAGCGCT ACCCCTGAGTCCGGCCCAGGTA CTTCTGAAAGCGCTACTCCTGA ATCCGGTCCAGGTACTTCTGAA AGCGCTACCCCGGAATCTGGCC CAGGTAGCGAACCGGCTACTTC TGGTTCTGAAACCCCAGGTAGC GAACCGGCTACCTCCGGTTCTG AAACTCCAGGTAGCCCAGCAGG CTCTCCGACTTCCACTGAGGAA GGTACTTCTACTGAACCTTCCG AAGGCAGCGCACCAGGTACCTC TACTGAACCTTCTGAGGGCAGC GCTCCAGGTAGCGAACCTGCAA CCTCTGGCTCTGAAACCCCAGG TACCTCTGAAAGCGCTACTCCT GAATCTGGCCCAGGTACTTCTA CTGAACCGTCCGAGGGCAGCGC ACCA | |
| FVII-MMP-17-AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK | 736 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTTAGAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA | 737 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | VGDSPNITEYMFC | | GTTGTGTGGGGGGACCCTGATC | |
| | AGYSDGSKDSCKG | | AACACCATCTGGGTGGTCTCCG | |
| | DSGGPHATHYRGT | | CGGCCCACTGTTTCGACAAAAT | |
| | WYLTGIVSWGQG | | CAAGAACTGGAGGAACCTGATC | |
| | CATVGHFGVYTRV | | GCGGTGCTGGGCGAGCACGACC | |
| | SQYIEWLQKLMRS | | TCAGCGAGCACGACGGGGATG | |
| | EPRPGVLLRAPFPG | | AGCAGAGCCGGCGGGTGGCGC | |
| | APLGLRLRGGSPA | | AGGTCATCATCCCCAGCACGTA | |
| | GSPTSTEEGTSESA | | CGTCCCGGGCACCACCAACCAC | |
| | TPESGPGTSTEPSE | | GACATCGCGCTGCTCCGCCTGC | |
| | GSAPGSPAGSPTST | | ACCAGCCCGTGGTCCTCACTGA | |
| | EEGTSTEPSEGSAP | | CCATGTGGTGCCCCTCTGCCTG | |
| | GTSTEPSEGSAPGT | | CCCGAACGGACGTTCTCTGAGA | |
| | SESATPESGPGSEP | | GGACGCTGGCCTTCGTGCGCTT | |
| | ATSGSETPGSEPAT | | CTCATTGGTCAGCGGCTGGGGC | |
| | SGSETPGSPAGSPT | | CAGCTGCTGGACCGTGGCGCCA | |
| | STEEGTSESATPES | | CGGCCCTGGAGCTCATGGTCCT | |
| | GPGTSTEPSEGSAP | | CAACGTGCCCCGGCTGATGACC | |
| | GTSTEPSEGSAPGS | | CAGGACTGCCTGCAGCAGTCAC | |
| | PAGSPTSTEEGTST | | GGAAGGTGGGAGACTCCCAA | |
| | EPSEGSAPGTSTEP | | ATATCACGGAGTACATGTTCTG | |
| | SEGSAPGTSESATP | | TGCCGGCTACTCGGATGGCAGC | |
| | ESGPGTSTEPSEGS | | AAGGACTCCTGCAAGGGGGAC | |
| | APGTSESATPESGP | | AGTGGAGGCCCACATGCCACCC | |
| | GSEPATSGSETPGT | | ACTACCGGGGCACGTGGTACCT | |
| | STEPSEGSAPGTST | | GACGGGCATCGTCAGCTGGGGC | |
| | EPSEGSAPGTSESA | | CAGGGCTGCGCAACCGTGGGCC | |
| | TPESGPGTSESATP | | ACTTTGGGGTGTACACCAGGGT | |
| | ESGPGSPAGSPTST | | CTCCCAGTACATCGAGTGGCTG | |
| | EEGTSESATPESGP | | CAAAAGCTCATGCGCTCAGAGC | |
| | GSEPATSGSETPGT | | CACGCCCAGGAGTCCTCCTGCG | |
| | SESATPESGPGTST | | AGCCCCATTTCCCGGTGGTGGT | |
| | EPSEGSAPGTSTEP | | AGCCCGGCTGGCTCTCCTACCT | |
| | SEGSAPGTSTEPSE | | CTACTGAGGAAGGTACTTCTGA | |
| | GSAPGTSTEPSEGS | | AAGCGCTACTCCTGAGTCTGGT | |
| | APGTSTEPSEGSAP | | CCAGGTACCTCTACTGAACCGT | |
| | GTSTEPSEGSAPGS | | CCGAAGGTAGCGCTCCAGGTAG | |
| | PAGSPTSTEEGTST | | CCCAGCAGGCTCTCCGACTTCC | |
| | EPSEGSAPGTSESA | | ACTGAGGAAGGTACTTCTACTG | |
| | TPESGPGSEPATSG | | AACCTTCCGAAGGCAGCGCACC | |
| | SETPGTSESATPES | | AGGTACCTCTACTGAACCTTCT | |
| | GPGSEPATSGSETP | | GAGGGCAGCGCTCCAGGTACTT | |
| | GTSESATPESGPGT | | CTGAAAGCGCTACCCCGGAATC | |
| | STEPSEGSAPGTSE | | TGGCCCAGGTAGCGAACCGGCT | |
| | SATPESGPGSPAGS | | ACTTCTGGTTCTGAAACCCCAG | |
| | PTSTEEGSPAGSPT | | GTAGCGAACCGGCTACCTCCGG | |
| | STEEGSPAGSPTST | | TTCTGAAACTCCAGGTAGCCCG | |
| | EEGTSESATPESGP | | GCAGGCTCTCCGACCTCTACTG | |
| | GTSTEPSEGSAPGT | | AGGAAGGTACTTCTGAAAGCGC | |
| | SESATPESGPGSEP | | AACCCCGGAGTCCGGCCCAGGT | |
| | ATSGSETPGTSESA | | ACCTCTACCGAACCGTCTGAGG | |
| | TPESGPGSEPATSG | | GCAGCGCACCAGGTACTTCTAC | |
| | SETPGTSESATPES | | CGAACCGTCCGAGGGTAGCGCA | |
| | GPGTSTEPSEGSAP | | CCAGGTAGCCCAGCAGGTTCTC | |
| | GSPAGSPTSTEEGT | | CTACCTCCACCGAGGAAGGTAC | |
| | SESATPESGPGSEP | | TTCTACCGAACCGTCCGAGGGT | |
| | ATSGSETPGTSESA | | AGCGCACCAGGTACCTCTACTG | |
| | TPESGPGSPAGSPT | | AACCTTCTGAGGGCAGCGCTCC | |
| | STEEGSPAGSPTST | | AGGTACTTCTGAAAGCGCTACC | |
| | EEGTSTEPSEGSAP | | CCGGAGTCCGGTCCAGGTACTT | |
| | GTSESATPESGPGT | | CTACTGAACCGTCCGAAGGTAG | |
| | SESATPESGPGTSE | | CGCACCAGGTACTTCTGAAAGC | |
| | SATPESGPGSEPAT | | GCAACCCCTGAATCCGGTCCAG | |
| | SGSETPGSEPATSG | | GTAGCGAACCGGCTACTTCTGG | |
| | SETPGSPAGSPTST | | CTCTGAGACTCCAGGTACTTCT | |
| | EEGTSTEPSEGSAP | | ACCGAACCGTCCGAAGGTAGCG | |
| | GTSTEPSEGSAPGS | | CACCAGGTACTTCTACTGAACC | |
| | EPATSGSETPGTSE | | GTCTGAAGGTAGCGCACCAGGT | |
| | SATPESGPGTSTEP | | ACTTCTGAAAGCGCAACCCCGG | |
| | SEGSAP | | AATCCGGCCCAGGTACCTCTGA | |
| | | | AAGCGCAACCCGGAGTCCGGC | |
| | | | CCAGGTAGCCCTGCTGGCTCTC | |
| | | | CAACCTCCACCGAAGAAGGTAC | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | CTCTGAAAGCGCAACCCCTGAA TCCGGCCCAGGTAGCGAACCGG CAACCTCCGGTTCTGAAACCCC AGGTACCTCTGAAAGCGCTACT CCGGAGTCTGGCCCAGGTACCT CTACTGAACCGTCTGAGGGTAG CGCTCCAGGTACTTCTACTGAA CCGTCCGAAGGTAGCGCACCAG GTACTTCTACCGAACCGTCCGA AGGCAGCGCTCCAGGTACCTCT ACTGAACCTTCCGAGGGCAGCG CTCCAGGTACCTCTACCGAACC TTCTGAAGGTAGCGCACCAGGT ACTTCTACCGAACCGTCCGAGG GTAGCGCACCAGGTAGCCCAGC AGGTTCTCCTACCTCCACCGAG GAAGGTACTTCTACCGAACCGT CCGAGGGTAGCGCACCAGGTAC CTCTGAAAGCGCAACTCCTGAG TCTGGCCCAGGTAGCGAACCTG CTACCTCCGGCTCTGAGACTCC AGGTACCTCTGAAAGCGCAACC CCGGAATCTGGTCCAGGTAGCG AACCTGCAACCTCTGGCTCTGA AACCCCAGGTACCTCTGAAAGC GCTACTCCTGAATCTGGCCCAG GTACTTCTACTGAACCGTCCGA GGGCAGCGCACCAGGTACTTCT GAAAGCGCTACTCCTGAGTCCG GCCCAGGTAGCCCGGCTGGCTC TCCGACTTCCACCGAGGAAGGT AGCCCGGCTGGCTCTCCAACTT CTACTGAAGAAGGTAGCCCGGC AGGCTCTCCGACCTCTACTGAG GAAGGTACTTCTGAAAGCGCAA CCCCGGAGTCCGGCCCAGGTAC CTCTACCGAACCGTCTGAGGGC AGCGCACCAGGTACCTCTGAAA GCGCAACTCCTGAGTCTGGCCC AGGTAGCGAACCTGCTACCTCC GGCTCTGAGACTCCAGGTACCT CTGAAAGCGCAACCCCGGAATC TGGTCCAGGTAGCGAACCTGCA ACCTCTGGCTCTGAAACCCCAG GTACCTCTGAAAGCGCTACTCC TGAATCTGGCCCAGGTACTTCT ACTGAACCGTCCGAGGGCAGCG CACCAGGTAGCCCTGCTGGCTC TCCAACCTCCACCGAAGAAGGT ACCTCTGAAAGCGCAACCCCTG AATCCGGCCCAGGTAGCGAACC GGCAACCTCCGGTTCTGAAACC CCAGGTACTTCTGAAAGCGCTA CTCCTGAGTCCGGCCCAGGTAG CCCGGCTGGCTCTCCGACTTCC ACCGAGGAAGGTAGCCCGGCTG GCTCTCCAACTTCTACTGAAGA AGGTACTTCTACCGAACCTTCC GAGGGCAGCGCACCAGGTACTT CTGAAAGCGCTACCCCTGAGTC CGGCCCAGGTACTTCTGAAAGC GCTACTCCTGAATCCGGTCCAG GTACTTCTGAAAGCGCTACCCC GGAATCTGGCCCAGGTAGCGAA CCGGCTACTTCTGGTTCTGAAA CCCCAGGTAGCGAACCGGCTAC CTCCGGTTCTGAAACTCCAGGT AGCCCAGCAGGCTCTCCGACTT CCACTGAGGAAGGTACTTCTAC TGAACCTTCCGAAGGCAGCGCA CCAGGTACCTCTACTGAACCTT CTGAGGGCAGCGCTCCAGGTAG CGAACCTGCAACCTCTGGCTCT | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | GAAACCCCAGGTACCTCTGAAA GCGCTACTCCTGAATCTGGCCC AGGTACTTCTACTGAACCGTCC GAGGGCAGCGCACCA | |
| FIX-MMP-17-FXIa | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGA PLGLRLRGKLTRA ET | 738 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGAGATCAGCTTTAGTTCTT CAGTACCTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGTGGT | 739 |
| FIX-MMP-17-Elastase | YNSGKLEEFVQGN LERECMEEKCSFE EAREVFENTERTT EFWKQYVDGDQC ESNPCLNGGSCKD DINSYECWCPFGF EGKNCELDVTCNI KNGRCEQFCKNSA DNKVVCSCTEGYR LAENQKSCEPAVP | 740 | TATAATTCAGGTAAATTGGAAG AGTTTGTTCAAGGGAACCTTGA GAGAGAATGTATGGAAGAAAA GTGTAGTTTTGAAGAAGCACGA GAAGTTTTTGAAAACACTGAAA GAACAACTGAATTTTGGAAGCA GTATGTTGATGGAGATCAGTGT GAGTCCAATCCATGTTTAAATG GCGGCAGTTGCAAGGATGACAT TAATTCCTATGAATGTTGGTGTC | 741 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | FPCGRVSVSQTSK LTRAETVFPDVDY VNSTEAETILDNIT QSTQSFNDFTRVV GGEDAKPGQFPW QVVLNGKVDAFC GGSIVNEKWIVTA AHCVETGVKITVV AGEHNIEETEHTE QKRNVIRIIPHHNY NAAINKYNHDIAL LELDEPLVLNSYV TPICIADKEYTNIFL KFGSGYVSGWGR VFHKGRSALVLQY LRVPLVDRATCLR STKFTIYNNMFCA GFHEGGRDSCQGD SGGPHVTEVEGTS FLTGIISWGEECAM KGKYGIYTKVSRY VNWIKEKTKLTGA PLGLRLR | | CCTTTGGATTTGAAGGAAAGAA CTGTGAATTAGATGTAACATGT AACATTAAGAATGGCAGATGCG AGCAGTTTTGTAAAAATAGTGC TGATAACAAGGTGGTTTGCTCC TGTACTGAGGGATATCGACTTG CAGAAACCAGAAGTCCTGTGA ACCAGCAGTGCCATTTCCATGT GGAAGAGTTTCTGTTTCACAAA CTTCTAAGCTCACCCGTGCTGA GACTGTTTTTCCTGATGTGGACT ATGTAAATTCTACTGAAGCTGA AACCATTTTGGATAACATCACT CAAAGCACCCAATCATTTAATG ACTTCACTCGGGTTGTTGGTGG AGAAGATGCCAAACCAGGTCA ATTCCCTTGGCAGGTTGTTTTGA ATGGTAAAGTTGATGCATTCTG TGGAGGCTCTATCGTTAATGAA AAATGGATTGTAACTGCTGCCC ACTGTGTTGAAACTGGTGTTAA AATTACAGTTGTCGCAGGTGAA CATAATATTGAGGAGACAGAAC ATACAGAGCAAAAGCGAAATG TGATTCGAATTATTCCTCACCAC AACTACAATGCAGCTATTAATA AGTACAACCATGACATTGCCCT TCTGGAACTGGACGAACCCTTA GTGCTAAACAGCTACGTTACAC CTATTTGCATTGCTGACAAGGA ATACACGAACATCTTCCTCAAA TTTGGATCTGGCTATGTAAGTG GCTGGGGAAGAGTCTTCCACAA AGGGGAGATCAGCTTTAGTTCTT CAGTACCTTAGAGTTCCACTTG TTGACCGAGCCACATGTCTTCG ATCTACAAAGTTCACCATCTAT AACAACATGTTCTGTGCTGGCT TCCATGAAGGAGGTAGAGATTC ATGTCAAGGAGATAGTGGGGG ACCCCATGTTACTGAAGTGGAA GGGACCAGTTTCTTAACTGGAA TTATTAGCTGGGGTGAAGAGTG TGCAATGAAAGGCAAATATGGA ATATATACCAAGGTATCCCGGT ATGTCAACTGGATTAAGGAAAA AACAAAGCTCACTGGGGT0 | |
| FVII-FIX AP-AE288 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC | 742 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC | 743 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | AGYSDGSKDSCKG | | AACACCATCTGGGTGGTCTCCG | |
| | DSGGPHATHYRGT | | CGGCCCACTGTTTCGACAAAAT | |
| | WYLTGIVSWGQG | | CAAGAACTGGAGGAACCTGATC | |
| | CATVGHFGVYTRV | | GCGGTGCTGGGCGAGCACGACC | |
| | SQYIEWLQKLMRS | | TCAGCGAGCACGACGGGGATG | |
| | EPRPGVLLRAPFPG | | AGCAGAGCCGGCGGGTGGCGC | |
| | KLTRAETVFPDVD | | AGGTCATCATCCCCAGCACGTA | |
| | YVNSTEAETILDNI | | CGTCCCGGGCACCACCAACCAC | |
| | TQSTQSFNDFTRV | | GACATCGCGCTGCTCCGCCTGC | |
| | VGGE | | ACCAGCCCGTGGTCCTCACTGA | |
| | GGTSESATPESGPG | | CCATGTGGTGCCCCTCTGCCTG | |
| | SEPATSGSETPGTS | | CCCGAACGGACGTTCTCTGAGA | |
| | ESATPESGPGSEPA | | GGACGCTGGCCTTCGTGCGCTT | |
| | TSGSETPGTSESAT | | CTCATTGGTCAGCGGCTGGGGC | |
| | PESGPGTSTEPSEG | | CAGCTGCTGGACCGTGGCGCCA | |
| | SAPGSPAGSPTSTE | | CGGCCCTGGAGCTCATGGTCCT | |
| | EGTSESATPESGPG | | CAACGTGCCCCGGCTGATGACC | |
| | SEPATSGSETPGTS | | CAGGACTGCCTGCAGCAGTCAC | |
| | ESATPESGPGSPAG | | GGAAGGTGGGAGACTCCCCAA | |
| | SPTSTEEGSPAGSP | | ATATCACGGAGTACATGTTCTG | |
| | TSTEEGTSTEPSEG | | TGCCGGCTACTCGGATGGCAGC | |
| | SAPGTSESATPESG | | AAGGACTCCTGCAAGGGGGAC | |
| | PGTSESATPESGPG | | AGTGGAGGCCCACATGCCACCC | |
| | TSESATPESGPGSE | | ACTACCGGGGCACGTGGTACCT | |
| | PATSGSETPGSEPA | | GACGGGCATCGTCAGCTGGGGC | |
| | TSGSETPGSPAGSP | | CAGGGCTGCGCAACCGTGGGCC | |
| | TSTEEGTSTEPSEG | | ACTTTGGGGTGTACACCAGGGT | |
| | SAPGTSTEPSEGSA | | CTCCCAGTACATCGAGTGGCTG | |
| | PGSEPATSGSETPG | | CAAAAGCTCATGCGCTCAGAGC | |
| | TSESATPESGPGTS | | CACGCCCAGGAGTCCTCCTGCG | |
| | TEPSEGSAP | | AGCCCCATTTCCCGGT0GGTGGT | |
| | | | ACCTCTGAAAGCGCAACTCCTG | |
| | | | AGTCTGGCCCAGGTAGCGAACC | |
| | | | TGCTACCTCCGGCTCTGAGACT | |
| | | | CCAGGTACCTCTGAAAGCGCAA | |
| | | | CCCCGGAATCTGGTCCAGGTAG | |
| | | | CGAACCTGCAACCTCTGGCTCT | |
| | | | GAAACCCCAGGTACCTCTGAAA | |
| | | | GCGCTACTCCTGAATCTGGCCC | |
| | | | AGGTACTTCTACTGAACCGTCC | |
| | | | GAGGGCAGCGCACCAGGTAGC | |
| | | | CCTGCTGGCTCTCCAACCTCCA | |
| | | | CCGAAGAAGGTACCTCTGAAAG | |
| | | | CGCAACCCCTGAATCCGGCCCA | |
| | | | GGTAGCGAACCGGCAACCTCCG | |
| | | | GTTCTGAAACCCCAGGTACTTC | |
| | | | TGAAAGCGCTACTCCTGAGTCC | |
| | | | GGCCCAGGTAGCCCGGCTGGCT | |
| | | | CTCCGACTTCCACCGAGGAAGG | |
| | | | TAGCCCGGCTGGCTCTCCAACT | |
| | | | TCTACTGAAGAAGGTACTTCTA | |
| | | | CCGAACCTTCCGAGGGCAGCGC | |
| | | | ACCAGGTACTTCTGAAAGCGCT | |
| | | | ACCCCTGAGTCCGGCCCAGGTA | |
| | | | CTTCTGAAAGCGCTACTCCTGA | |
| | | | ATCCGGTCCAGGTACTTCTGAA | |
| | | | AGCGCTACCCCGGAATCTGGCC | |
| | | | CAGGTAGCGAACCGGCTACTTC | |
| | | | TGGTTCTGAAACCCCAGGTAGC | |
| | | | GAACCGGCTACCTCCGGTTCTG | |
| | | | AAACTCCAGGTAGCCCAGCAGG | |
| | | | CTCTCCGACTTCCACTGAGGAA | |
| | | | GGTACTTCTACTGAACCTTCCG | |
| | | | AAGGCAGCGCACCAGGTACCTC | |
| | | | TACTGAACCTTCTGAGGGCAGC | |
| | | | GCTCCAGGTAGCGAACCTGCAA | |
| | | | CCTCTGGCTCTGAAACCCCAGG | |
| | | | TACCTCTGAAAGCGCTACTCCT | |
| | | | GAATCTGGCCCAGGTACTTCTA | |
| | | | CTGAACCGTCCGAGGGCAGCGC | |
| | | | ACCA | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| FVII-FIX AP-AE864 | ANAFLEELRPGSLE RECKEEQCSFEEA REIFKDAERTKLF WISYSDGDQCASS PCQNGGSCKDQLQ SYICFCLPAFEGRN CETHKDDQLICVN ENGGCEQYCSDHT GTKRSCRCHEGYS LLADGVSCTPTVE YPCGKIPILEKRNA SKPQGRIVGGKVC PKGECPWQVLLLV NGAQLCGGTLINTI WVVSAAHCFDKIK NWRNLIAVLGEHD LSEHDGDEQSRRV AQVIIPSTYVPGTT NHDIALLRLHQPV VLTDHVVPLCLPE RTFSERTLAFVRFS LVSGWGQLLDRG ATALELMVLNVPR LMTQDCLQQSRK VGDSPNITEYMFC AGYSDGSKDSCKG DSGGPHATHYRGT WYLTGIVSWGQG CATVGHFGVYTRV SQYIEWLQKLMRS EPRPGVLLRAPFPG KLTRAETVFPDVD YVNSTEAETILDNI TQSTQSFNDFTRV VGGE GGSPAGSPTSTEEG TSESATPESGPGTS TEPSEGSAPGSPAG SPTSTEEGTSTEPS EGSAPGTSTEPSEG SAPGTSESATPESG PGSEPATSGSETPG SEPATSGSETPGSP AGSPTSTEEGTSES ATPESGPGTSTEPS EGSAPGTSTEPSEG SAPGSPAGSPTSTE EGTSTEPSEGSAPG TSTEPSEGSAPGTS ESATPESGPGTSTE PSEGSAPGTSESAT PESGPGSEPATSGS ETPGTSTEPSEGSA PGTSTEPSEGSAPG TSESATPESGPGTS ESATPESGPGSPAG SPTSTEEGTSESAT PESGPGSEPATSGS ETPGTSESATPESG PGTSTEPSEGSAPG TSTEPSEGSAPGTS TEPSEGSAPGTSTE PSEGSAPGTSTEPS EGSAPGTSTEPSEG SAPGSPAGSPTSTE EGTSTEPSEGSAPG TSESATPESGPGSE PATSGSETPGTSES ATPESGPGSEPATS GSETPGTSESATPE SGPGTSTEPSEGSA PGTSESATPESGPG SPAGSPTSTEEGSP | 744 | GCCAACGCGTTCCTGGAGGAGC TACGGCCGGGCTCCCTGGAGAG GGAGTGCAAGGAGGAGCAGTG CTCCTTCGAGGAGGCCCGGGAG ATCTTCAAGGACGCGGAGAGGA CGAAGCTGTTCTGGATTTCTTAC AGTGATGGGGACCAGTGTGCCT CAAGTCCATGCCAGAATGGGGG CTCCTGCAAGGACCAGCTCCAG TCCTATATCTGCTTCTGCCTCCC TGCCTTCGAGGGCCGGAACTGT GAGACGCACAAGGATGACCAG CTGATCTGTGTGAACGAGAACG GCGGCTGTGAGCAGTACTGCAG TGACCACACGGGCACCAAGCGC TCCTGTCGGTGCCACGAGGGGT ACTCTCTGCTGGCAGACGGGGT GTCCTGCACACCCACAGTTGAA TATCCATGTGGAAAAATACCTA TTCTAGAAAAAAGAAATGCCAG CAAACCCCAAGGCCGAATTGTG GGGGGCAAGGTGTGCCCCAAA GGGGAGTGTCCATGGCAGGTCC TGTTGTTGGTGAATGGAGCTCA GTTGTGTGGGGGGACCCTGATC AACACCATCTGGGTGGTCTCCG CGGCCCACTGTTTCGACAAAAT CAAGAACTGGAGGAACCTGATC GCGGTGCTGGGCGAGCACGACC TCAGCGAGCACGACGGGGATG AGCAGAGCCGGCGGGTGGCGC AGGTCATCATCCCCAGCACGTA CGTCCCGGGCACCACCAACCAC GACATCGCGCTGCTCCGCCTGC ACCAGCCCGTGGTCCTCACTGA CCATGTGGTGCCCCTCTGCCTG CCCGAACGGACGTTCTCTGAGA GGACGCTGGCCTTCGTGCGCTT CTCATTGGTCAGCGGCTGGGGC CAGCTGCTGGACCGTGGCGCCA CGGCCCTGGAGCTCATGGTCCT CAACGTGCCCCGGCTGATGACC CAGGACTGCCTGCAGCAGTCAC GGAAGGTGGGAGACTCCCCAA ATATCACGGAGTACATGTTCTG TGCCGGCTACTCGGATGGCAGC AAGGACTCCTGCAAGGGGGAC AGTGGAGGCCCACATGCCACCC ACTACCGGGGCACGTGGTACCT GACGGGCATCGTCAGCTGGGGC CAGGGCTGCGCAACCGTGGGCC ACTTTGGGGTGTACACCAGGGT CTCCCAGTACATCGAGTGGCTG CAAAAGCTCATGCGCTCAGAGC CACGCCCAGGAGTCCTCCTGCG AGCCCCATTTCCCGGTGGTGGT AGCCCGGCTGGCTCTCCTACCT CTACTGAGGAAGGTACTTCTGA AAGCGCTACTCCTGAGTCTGGT CCAGGTACCTCTACTGAACCGT CCGAAGGTAGCGCTCCAGGTAG CCCAGCAGGCTCTCCGACTTCC ACTGAGGAAGGTACTTCTACTG AACCTTCCGAAGGCAGCGCACC AGGTACCTCTACTGAACCTTCT GAGGGCAGCGCTCCAGGTACTT CTGAAAGCGCTACCCCGGAATC TGGCCCAGGTAGCGAACCGGCT ACTTCTGGTTCTGAAACCCCAG GTAGCGAACCGGCTACTCCGG TTCTGAAACTCCAGGTAGCCCG GCAGGCTCTCCGACCTCTACTG AGGAAGGTACTTCTGAAAGCGC | 745 |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | AGSPTSTEEGSPAG | | AACCCCGGAGTCCGGCCCAGGT | |
| | SPTSTEEGTSESAT | | ACCTCTACCGAACCGTCTGAGG | |
| | PESGPGTSTEPSEG | | GCAGCGCACCAGGTACTTCTAC | |
| | SAPGTSESATPESG | | CGAACCGTCCGAGGGTAGCGCA | |
| | PGSEPATSGSETPG | | CCAGGTAGCCCAGCAGGTTCTC | |
| | TSESATPESGPGSE | | CTACCTCCACCGAGGAAGGTAC | |
| | PATSGSETPGTSES | | TTCTACCGAACCGTCCGAGGGT | |
| | ATPESGPGTSTEPS | | AGCGCACCAGGTACCTCTACTG | |
| | EGSAPGSPAGSPTS | | AACCTTCTGAGGGCAGCGCTCC | |
| | TEEGTSESATPESG | | AGGTACTTCTGAAAGCGCTACC | |
| | PGSEPATSGSETPG | | CCGGAGTCCGGTCCAGGTACTT | |
| | TSESATPESGPGSP | | CTACTGAACCGTCCGAAGGTAG | |
| | AGSPTSTEEGSPAG | | CGCACCAGGTACTTCTGAAAGC | |
| | SPTSTEEGTSTEPS | | GCAACCCCTGAATCCGGTCCAG | |
| | EGSAPGTSESATPE | | GTAGCGAACCGGTACTTCTGG | |
| | SGPGTSESATPESG | | CTCTGAGACTCCAGGTACTTCT | |
| | PGTSESATPESGPG | | ACCGAACCGTCCGAAGGTAGCG | |
| | SEPATSGSETPGSE | | CACCAGGTACTTCTACTGAACC | |
| | PATSGSETPGSPAG | | GTCTGAAGGTAGCGCACCAGGT | |
| | SPTSTEEGTSTEPS | | ACTTCTGAAAGCGCAACCCCGG | |
| | EGSAPGTSTEPSEG | | AATCCGGCCCAGGTACCTCTGA | |
| | SAPGSEPATSGSET | | AAGCGCAACCCCGGAGTCCGGC | |
| | PGTSESATPESGPG | | CCAGGTAGCCCTGCTGGCTCTC | |
| | TSTEPSEGSAP | | CAACCTCCACCGAAGAAGGTAC | |
| | | | CTCTGAAAGCGCAACCCCTGAA | |
| | | | TCCGGCCCAGGTAGCGAACCGG | |
| | | | CAACCTCCGGTTCTGAAACCCC | |
| | | | AGGTACCTCTGAAAGCGCTACT | |
| | | | CCGGAGTCTGGCCCAGGTACCT | |
| | | | CTACTGAACCGTCTGAGGGTAG | |
| | | | CGCTCCAGGTACTTCTACTGAA | |
| | | | CCGTCCGAAGGTAGCGCACCAG | |
| | | | GTACTTCTACCGAACCGTCCGA | |
| | | | AGGCAGCGCTCCAGGTACCTCT | |
| | | | ACTGAACCTTCCGAGGGCAGCG | |
| | | | CTCCAGGTACCTCTACCGAACC | |
| | | | TTCTGAAGGTAGCGCACCAGGT | |
| | | | ACTTCTACCGAACCGTCCGAGG | |
| | | | GTAGCGCACCAGGTAGCCCAGC | |
| | | | AGGTTCTCCTACCTCCACCGAG | |
| | | | GAAGGTACTTCTACCGAACCGT | |
| | | | CCGAGGGTAGCGCACCAGGTAC | |
| | | | CTCTGAAAGCGCAACTCCTGAG | |
| | | | TCTGGCCCAGGTAGCGAACCTG | |
| | | | CTACCTCCGGCTCTGAGACTCC | |
| | | | AGGTACCTCTGAAAGCGCAACC | |
| | | | CCGGAATCTGGTCCAGGTAGCG | |
| | | | AACCTGCAACCTCTGGCTCTGA | |
| | | | AACCCCAGGTACCTCTGAAAGC | |
| | | | GCTACTCCTGAATCTGGCCCAG | |
| | | | GTACTTCTACTGAACCGTCCGA | |
| | | | GGGCAGCGCACCAGGTACTTCT | |
| | | | GAAAGCGCTACTCCTGAGTCCG | |
| | | | GCCCAGGTAGCCCGGCTGGCTC | |
| | | | TCCGACTTCCACCGAGGAAGGT | |
| | | | AGCCCGGCTGGCTCTCCAACTT | |
| | | | CTACTGAAGAAGGTAGCCCGGC | |
| | | | AGGCTCTCCGACCTCTACTGAG | |
| | | | GAAGGTACTTCTGAAAGCGCAA | |
| | | | CCCCGGAGTCCGGCCCAGGTAC | |
| | | | CTCTACCGAACCGTCTGAGGGC | |
| | | | AGCGCACCAGGTACCTCTGAAA | |
| | | | GCGCAACTCCTGAGTCTGGCCC | |
| | | | AGGTAGCGAACCTGCTACCTCC | |
| | | | GGCTCTGAGACTCCAGGTACCT | |
| | | | CTGAAAGCGCAACCCCGGAATC | |
| | | | TGGTCCAGGTAGCGAACCTGCA | |
| | | | ACCTCTGGCTCTGAAACCCCAG | |
| | | | GTACCTCTGAAAGCGCTACTCC | |
| | | | TGAATCTGGCCCAGGTACTTCT | |
| | | | ACTGAACCGTCCGAGGGCAGCG | |
| | | | CACCAGGTAGCCCTGCTGGCTC | |
| | | | TCCAACCTCCACCGAAGAAGGT | |

TABLE 42-continued

Exemplary CFXTEN comprising CF, cleavage sequences and XTEN sequences

| CFXTEN Name* | Amino Acid Sequence | SEQ ID NO: | DNA Nucleotide Sequence | SEQ ID NO: |
|---|---|---|---|---|
| | | | ACCTCTGAAAGCGCAACCCCTG AATCCGGCCCAGGTAGCGAACC GGCAACCTCCGGTTCTGAAACC CCAGGTACTTCTGAAAGCGCTA CTCCTGAGTCCGGCCCAGGTAG CCCGGCTGGCTCTCCGACTTCC ACCGAGGAAGGTAGCCCGGCTG GCTCTCCAACTTCTACTGAAGA AGGTACTTCTACCGAACCTTCC GAGGGCAGCGCACCAGGTACTT CTGAAAGCGCTACCCCTGAGTC CGGCCCAGGTACTTCTGAAAGC GCTACTCCTGAATCCGGTCCAG GTACTTCTGAAAGCGCTACCCC GGAATCTGGCCCAGGTAGCGAA CCGGCTACTTCTGGTTCTGAAA CCCCAGGTAGCGAACCGGCTAC CTCCGGTTCTGAAACTCCAGGT AGCCCAGCAGGCTCTCCGACTT CCACTGAGGAAGGTACTTCTAC TGAACCTTCCGAAGGCAGCGCA CCAGGTACCTCTACTGAACCTT CTGAGGGCAGCGCTCCAGGTAG CGAACCTGCAACCTCTGGCTCT GAAACCCCAGGTACCTCTGAAA GCGCTACTCCTGAATCTGGCCC AGGTACTTCTACTGAACCGTCC GAGGGCAGCGCACCA | |

*Sequence name reflects N- to C-terminus configuration of the CF, cleavage sequence and XTEN components

TABLE 43

Exemplary FVII variants incorporating FIX AP sequence, cleavage sequences and XTEN**

| FVII Construct Name* | Amino Acid Sequence | SEQ ID NO: |
|---|---|---|
| FVII(Gla-EGF2)-(AP)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGEQSRRVAQVIIPSTYVPGTTNGS KLTRAETVFPDVDYVNSTEAETILDNITQSTQSFNDFTRVVGGEGSKPQ GRHDIALLRLHQPVVLTDHVVPLCLPERTFSERTLAFVRFSLVSGWGQ LLDRGATALELMVLNVPRLMTQDCLQQSRKVGDSPNITEYMFCAGYS DGSKDSCKGDSGGPHATHYRGTWYLTGIVSWGQGCATVGHFGVYTR VSQYIEWLQKLMRSEPRPGVLLRAPFP | 746 |
| FVII(Gla-EGF2)-(AP)-FVII(Pro)-AE288 | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGEQSRRVAQVIIPSTYVPGTTNGS KLTRAETVFPDVDYVNSTEAETILDNITQSTQSFNDFTRVVGGEGSKPQ GRHDIALLRLHQPVVLTDHVVPLCLPERTFSERTLAFVRFSLVSGWGQ LLDRGATALELMVLNVPRLMTQDCLQQSRKVGDSPNITEYMFCAGYS DGSKDSCKGDSGGPHATHYRGTWYLTGIVSWGQGCATVGHFGVYTR VSQYIEWLQKLMRSEPRPGVLLRAPFPGGTSESATPESGPGSEPATSGS ETPGTSESATPESGPGSEPATSGSETPGTSESATPESGPGTSTEPSEGSAP GSPAGSPTSTEEGTSESATPESGPGSEPATSGSETPGTSESATPESGPGSP AGSPTSTEEGSPAGSPTSTEEGTSTEPSEGSAPGTSESATPESGPGTSESA TPESGPGTSESATPESGPGSEPATSGSETPGSEPATSGSETPGSPAGSPTS TEEGTSTEPSEGSAPGSEPATSGSETPGTSESATPESGP GTSTEPSEGSAP | 747 |
| FVII(Gla-EGF2)-(AP)- | ANAFLEELRPGSLERECKEEQCSFEEAREIFKDAERTKLFWISYSDGDQ CASSPCQNGGSCKDQLQSYICFCLPAFEGRNCETHKDDQLICVNENGG | 748 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| FVII(Pro)-AE864 | CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNGS KLTRAETVFPDVDYVNSTEAETILDNITQSTQSFNDFTRVVGGEGSKPQ GRHDIALLRLHQPVVLTDHVVPLCLPERTFSERTLAFVRFSLVSGWGQ LLDRGATALELMVLNVPRLMTQDCLQQSRKVGDSPNITEYMFCAGYS DGSKDSCKGDSGGPHATHYRGTWYLTGIVSWGQGCATVGHFGVYTR VSQYIEWLQKLMRSEPRPGVLLRAPFPGGSPAGSPTSTEEGTSESATPES GPGTSTEPSEGSAPGSPAGSPTSTEEGTSTEPSEGSAPGTSTEPSEGSAPG TSESATPESGPGSEPATSGSETPGSEPATSGSETPGSPAGSPTSTEEGTSE SATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPES GPGSEPATSGSETPGTSTEPSEGSAPGTSTEPSEGSAPGTSESATPESGPG TSESATPESGPGSPAGSPTSTEEGTSESATPESGPGSEPATSGSETPGTSE SATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGS APGTSESATPESGPGSEPATSGSETPGTSESATPESGPGSEPATSGSETPG TSESATPESGPGSPAGSPTSTEEGSPAGSPTSTEEGTSESATPESGPGTSE GSPTSTEEGSPAGSPTSTEEGTSESATPESGPGTSTEPSEGSAPGTSESAT PESGPGSEPATSGSETPGTSESATPESGPGSEPATSGSETPGTSESATPES GPGTSTEPSEGSAPGSPAGSPTSTEEGTSESATPESGPGSEPATSGSETPG TSESATPESGPGSPAGSPTSTEEGSPAGSPTSTEEGTSTEPSEGSAPGTSE SATPESGPGTSESATPESGPGSEPATSGSETPGSEPATS GSETPGSPAGSPTSTEEGTSTEPSEGSAPGTSTEPSEGSAPGSEPATSGSE TPGTSESATPESGPGTSTEPSEGSAP | |
| FVII(Gla-EGF2)-(K142-V149)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNG KLTRAETVGSKPQGRHDIALLRLHQPVVLTDHVVPLCLPERTFSERTLA FVRFSLVSGWGQLLDRGATALELMVLNVPRLMTQDCLQQSRKVGDSP NITEYMFCAGYSDGSKDSCKGDSGGPHATHYRGTWYLTGIVSWGQGC ATVGHFGVYTRVSQYIEWLQKLMRSEPRPGVLLRAPFP | 749 |
| FVII(Gla-EGF2)-(K142-V149)-FVII(Pro)-AE288 | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNG KLTRAETVGSKPQGRHDIALLRLHQPVVLTDHVVPLCLPERTFSERTLA FVRFSLVSGWGQLLDRGATALELMVLNVPRLMTQDCLQQSRKVGDSP NITEYMFCAGYSDGSKDSCKGDSGGPHATHYRGTWYLTGIVSWGQGC ATVGHFGVYTRVSQYIEWLQKLMRSEPRPGVLLRAPFPGGTSESATPE SGPGSEPATSGSETPGTSESATPESGPGSEPATSGSETPGTSESATPESGP GTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESA TPESGPGTSESATPESGPGTSESATPESGPGSEPATSGSETPGSEPATSGS ETPGSPAGSPTSTEEGTSTEPSEGSAPGTSTEPSEGSAPGSEPATSGSETP GTSESATPESGPGTSTEPSEGSAP | 750 |
| FVII(Gla-EGF2)-(K142-V149)-FVII(Pro)-AE864 | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNG KLTRAETVGSKPQGRHDIALLRLHQPVVLTDHVVPLCLPERTFSERTLA FVRFSLVSGWGQLLDRGATALELMVLNVPRLMTQDCLQQSRKVGDSP NITEYMFCAGYSDGSKDSCKGDSGGPHATHYRGTWYLTGIVSWGQGC ATVGHFGVYTRVSQYIEWLQKLMRSEPRPGVLLRAPFPGGSPAGSPTS TEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSP AGSPTSTEEGTSESATPESGPGTSTEPSEGSAPGTSTEPSEGSAPGSPAGS PTSTEEGTSTEPSEGSAPGTSTEPSEGSAPGTSESATPESGPGTSTEPSEG SAPGTSESATPESGPGSEPATSGSETPGTSTEPSEGSAPGTSTEPSEGSAP GTSESATPESGPGTSESATPESGPGSPAGSPTSTEEGTSESATPESGPGSE PATSGSETPGTSESATPESGPGTSTEPSEGSAPGTSESATPESGPGTSTEP SEGSAPGTSTEPSEGSAPGTSTEPSEGSAPGTSTEPSEGSAPGSPAGSPTS TEEGTSTEPSEGSAPGTSESATPESGPGSEPATSGSETPGTSESATPESGP GSEPATSGSETPGTSESATPESGPGTSTEPSEGSAPGTSESATPESGPGSP AGSPTSTEEGSPAGSPTSTEEGSPAGSPTSTEEGTSESATPESGPGTSTEP SEGSAPGTSESATPESGPGSEPATSGSETPGTSESATPESGPGSEPATSGS | 751 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| | ETPGTSESATPESGPGTSTEPSEGSAPGSPAGSPTSTEEGTSESATPESGP GSEPATSGSETPGTSESATPESGPGSPAGSPTSTEEGSPAGSPTSTEEGTS TEPSEGSAPGTSESATPESGPGTSESATPESGPGTSESATPESGPGSEPAT SGSETPGSEPATSGSETPGSPAGSPTSTEEGTSTEPSEGSAPGTSTEPSEG SAPGSEPATSGSETPGTSESATPESGPGTSTEPSEGSAP | |
| FVII(Gla-EGF2)-(D177-G184)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNG DFTRVVGGGSKPQGRHDIALLRLHQPVVLTDHVVPLCLPERTFSERTL AFVRFSLVSGWGQLLDRGATALELMVLNVPRLMTQDCLQQSRKVGD SPNITEYMFCAGYSDGSKDSCKGDSGGPHATHYRGTWYLTGIVSWGQ GCATVGHFGVYTRVSQYIEWLQKLMRSEPRPGVLLRAPFP | 752 |
| FVII(Gla-EGF2)-(D177-G184)-FVII(Pro)-AE288 | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNG DFTRVVGGGSKPQGRHDIALLRLHQPVVLTDHVVPLCLPERTFSERTL AFVRFSLVSGWGQLLDRGATALELMVLNVPRLMTQDCLQQSRKVGD SPNITEYMFCAGYSDGSKDSCKGDSGGPHATHYRGTWYLTGIVSWGQ GCATVGHFGVYTRVSQYIEWLQKLMRSEPRPGVLLRAPFPGGTSESAT PESGPGSEPATSGSETPGTSESATPESGPGSEPATSGSETPGTSESATPES GPGTSTEPSEGSAPGSPAGSPTSTEEGTSESATPESGPGSEPATSGSETPG TSESATPESGPGSPAGSPTSTEEGSPAGSPTSTEEGTSTEPSEGSAPGTSE SATPESGPGTSESATPESGPGTSESATPESGPGSEPATSGSETPGSEPATS GSETPGSPAGSPTSTEEGTSTEPSEGSAPGTSTEPSEGSAPGSEPATSGSE TPGTSESATPESGPGTSTEPSEGSAP | 753 |
| FVII(Gla-EGF2)-(D177-G184)-FVII(Pro)-AE864 | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKPQIVGGKVCPKGECPWQVLLLVNGAQLCGGGRTLINTIWVVSAAH CFDKIKNWRNLIAVLGEHDLSEHDGDEQSRRVAQVIIPSTYVPGTTNG DFTRVVGGGSKPQGRHDIALLRLHQPVVLTDHVVPLCLPERTFSERTL AFVRFSLVSGWGQLLDRGATALELMVLNVPRLMTQDCLQQSRKVGD SPNITEYMFCAGYSDGSKDSCKGDSGGPHATHYRGTWYLTGIVSWGQ GCATVGHFGVYTRVSQYIEWLQKLMRSEPRPGVLLRAPFPGGSPAGSP TSTEEGTSESATPESGPGTSTEPSEGSAPGSPAGSPTSTEEGTSTEPSEGS APGTSTEPSEGSAPGTSESATPESGPGSEPATSGSETPGSEPATSGSETPG SPAGSPTSTEEGTSESATPESGPGTSTEPSEGSAPGTSTEPSEGSAPGSPA GSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGS APGTSESATPESGPGTSESATPESGPGSPAGSPTSTEEGTSESATPESGPG SEPATSGSETPGTSESATPESGPGTSTEPSEGSAPGTSTEPSEGSAPGTST EPSEGSAPGTSTEPSEGSAPGTSTEPSEGSAPGTSTEPSEGSAPGSPAGSP TSTEEGTSTEPSEGSAPGTSESATPESGPGSEPATSGSETPGTSESATPES GPGSEPATSGSETPGTSESATPESGPGTSTEPSEGSAPGTSESATPESGPG SPAGSPTSTEEGSPAGSPTSTEEGSPAGSPTSTEEGTSESATPESGPGTST EPSEGSAPGTSESATPESGPGSEPATSGSETPGTSESATPESGPGSEPATS GSETPGTSESATPESGPGTSTEPSEGSAPGSPAGSPTSTEEGTSESATPES GPGSEPATSGSETPGTSESATPESGPGSPAGSPTSTEEGSPAGSPTSTEEG TSTEPSEGSAPGTSESATPESGPGTSESATPESGPGSEP ATSGSETPGSEPATSGSETPGSPAGSPTSTEEGTSTEPSEGSAPGTSTEPS EGSAPGSEPATSGSETPGTSESATPESGPGTSTEPSEGSAP | 754 |
| FVII(Gla-EGF2)-(D177-T179)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKDFTRIVGGKVCPKGECPWQVLLLVNGAQLCGGTLINTIWVVSAAH CFDKIKNWRNLIAVLGEHDLSEHDGDEQSRRVAQVIIPSTYVPGTTNH DIALLRLHQPVVLTDHVVPLCLPERTFSERTLAFVRFSLVSGWGQLLDR GATALELMVLNVPRLMTQDCLQQSRKVGDSPNITEYMFCAGYSDGSK DSCKGDSGGPHATHYRGTWYLTGIVSWGQGCATVGHFGVYTRVSQYI EWLQKLMRSEPRPGVLLRAPFP | 755 |
| FVII(Gla-EGF2)-(D177-T179)-FVII(Pro)-KLTRAET- | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKDFTRIVGGKVCPKGECPWQVLLLVNGAQLCGGTLINTIWVVSAAH | 756 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| AE288 ('KLTRAET' disclosed as SEQ ID NO: 6) | CFDKIKNWRNLIAVLGEHDLSEHDGDEQSRRVAQVIIPSTYVPGTTNH DIALLRLHQPVVLTDHVVPLCLPERTFSERTLAFVRFSLVSGWGQLLDR GATALELMVLNVPRLMTQDCLQQSRKVGDSPNITEYMFCAGYSDGSK DSCKGDSGGPHATHYRGTWYLTGIVSWGQGCATVGHFGVYTRVSQYI EWLQKLMRSEPRPGVLLRAPFPGTSESATPESGPGSEPATSGSETPGTSE SATPESGPGSEPATSGSETPGTSESATPESGPGTSTEPSEGSAPGSPAGSP TSTEEGTSESATPESGPGSEPATSGSETPGTSESATPESGPGSPAGSPTST EEGSPAGSPTSTEEGTSTEPSEGSAPGTSESATPESGPGTSESATPESGPG TSESATPESGPGSEPATSGSETPGSEPATSGSETPGSPAGSPTSTEEGTST EPSEGSAPGTSTEPSEGSAPGSEPATSGSETPGTSESATPESGPGTSTEPS EGSAP | |
| FVII(Gla-EGF2)-(D177-T179)-FVII(Pro)-KLTRAET-AE864('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKDFTRIVGGKVCPKGECPWQVLLLVNGAQLCGGTLINTIWVVSAAH CFDKIKNWRNLIAVLGEHDLSEHDGDEQSRRVAQVIIPSTYVPGTTNH DIALLRLHQPVVLTDHVVPLCLPERTFSERTLAFVRFSLVSGWGQLLDR GATALELMVLNVPRLMTQDCLQQSRKVGDSPNITEYMFCAGYSDGSK DSCKGDSGGPHATHYRGTWYLTGIVSWGQGCATVGHFGVYTRVSQYI EWLQKLMRSEPRPGVLLRAPFPGEGPSKLTRAETGSPGSPAGSPTSTE EGTSESATPESGPGTSTEPSEGSAPGSPAGSPTSTEEGTSTEPSEGSAPGT STEPSEGSAPGTSESATPESGPGSEPATSGSETPGSEPATSGSETPGSPAG SPTSTEEGTSESATPESGPGTSTEPSEGSAPGTSTEPSEGSAPGSPAGSPT STEEGTSTEPSEGSAPGTSTEPSEGSAPGTSESATPESGPGTSTEPSEGSA PGTSESATPESGPGSEPATSGSETPGTSESATPESGPGTSTEPSEGSAPGT SESATPESGPGTSESATPESGPGSPAGSPTSTEEGTSESATPESGPGSEPA TSGSETPGTSESATPESGPGTSTEPSEGSAPGTSTEPSEGSAPGTSTEPSE GSAPGTSTEPSEGSAPGTSTEPSEGSAPGTSTEPSEGSAPGSPAGSPTSTE EGTSTEPSEGSAPGTSESATPESGPGSEPATSGSETPGTSESATPESGPGS EPATSGSETPGTSESATPESGPGTSTEPSEGSAPGTSTEPSEGSAPGSPAG SPTSTEEGSPAGSPTSTEEGSPAGSPTSTEEGTSESATPESGPGTSTEPSE GSAPGTSESATPESGPGSEPATSGSETPGTSESATPESGPGSEPATSGSET PGTSESATPESGPGTSTEPSEGSAPGSPAGSPTSTEEGTSESATPESGPGS EPATSGSETPGTSESATPESGPGSPAGSPTSTEEGSPAGSPTSTEEGTSTE PSEGSAPGTSESATPESGPGTSESATPESGPGTSESATPESGPGSEPATSG SETPGSEPATSGSETPGSPAGSPTSTEEGTSTEPSEGSAPGTSTEPSEGSA PGSEPATSGSETPGTSESATPESGPGTSTEPSEGSAPGSSS | 757 |
| FVII(Gla-EGF2)-(K142-T179)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRKL TRAETVFPDVDYVNSTEAETILDNITQSTQSFNDFTRIVGGKVCPKGEC PWQVLLLVNGAQLCGGTLINTIWVVSAAHCFDKIKNWRNLIAVLGEH DLSEHDGDEQSRRVAQVIIPSTYVPGTTNHDIALLRLHQPVVLTDHVVP LCLPERTFSERTLAFVRFSLVSGWGQLLDRGATALELMVLNVPRLMTQ DCLQQSRKVGDSPNITEYMFCAGYSDGSKDSCKGDSGGPHATHYRGT WYLTGIVSWGQGCATVGHFGVYTRVSQYIEWLQKLMRSEPRPGVLLR APFP | 758 |
| FVII(Gla-EGF2)-(K142-T179)-FVII(Pro)-KLTRAET-AE288('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRKL TRAETVFPDVDYVNSTEAETILDNITQSTQSFNDFTRIVGGKVCPKGEC PWQVLLLVNGAQLCGGTLINTIWVVSAAHCFDKIKNWRNLIAVLGEH DLSEHDGDEQSRRVAQVIIPSTYVPGTTNHDIALLRLHQPVVLTDHVVP LCLPERTFSERTLAFVRFSLVSGWGQLLDRGATALELMVLNVPRLMTQ DCLQQSRKVGDSPNITEYMFCAGYSDGSKDSCKGDSGGPHATHYRGT WYLTGIVSWGQGCATVGHFGVYTRVSQYIEWLQKLMRSEPRPGVLLR APFPGPEGPSKLTRAETGTSESATPESGPGSEPATSGSETPGTSESATPES GPGSEPATSGSETPGTSESATPESGPGTSTEPSEGSAPGSPAGSPTSTEEG TSESATPESGPGSEPATSGSETPGTSESATPESGPGSPAGSPTSTEEGSPA GSPTSTEEGTSTEPSEGSAPGTSESATPESGPGTSESATPESGPGTSESAT PESGPGSEPATSGSETPGSEPATSGSETPGSPAGSPTSTEEGTSTEPSEGS APGTSTEPSEGSAPGSEPATSGSETPGTSESATPESGPGTSTEPSEGSAP | 759 |
| FVII(Gla-EGF2)-(K142-T179)-FVII(Pro)-KLTRAET-AE864('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRKL TRAETVFPDVDYVNSTEAETILDNITQSTQSFNDFTRIVGGKVCPKGEC PWQVLLLVNGAQLCGGTLINTIWVVSAAHCFDKIKNWRNLIAVLGEH DLSEHDGDEQSRRVAQVIIPSTYVPGTTNHDIALLRLHQPVVLTDHVVP LCLPERTFSERTLAFVRFSLVSGWGQLLDRGATALELMVLNVPRLMTQ | 760 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| 6) | DCLQQSRKVGDSPNITEYMFCAGYSDGSKDSCKGDSGGPHATHYRGT WYLTGIVSWGQGCATVGHFGVYTRVSQYIEWLQKLMRSEPRPGVLLR APFPGPEGPSKLTRAETGSPGSPAGSPTSEEGTSESATPESGPGTSTEPS EGSAPGSPAGSPTSTEEGTSTEPSEGSAPGTSTEPSEGSAPGTSESATPES GPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTST EPSEGSAPGTSESATPESGPGTSTEPSEGSAPGTSESATPESGPGSEPATS GSETPGTSTEPSEGSAPGTSTEPSEGSAPGTSESATPESGPGTSESATPES GPGSPAGSPTSTEEGTSESATPESGPGSEPATSGSETPGTSESATPESGPG TSTEPSEGSAPGTSTEPSEGSAPGTSTEPSEGSAPGTSTEPSEGSAPGTST EPSEGSAPGTSTEPSEGSAPGSPAGSPTSTEEGTSTEPSEGSAPGTSESAT PESGPGSEPATSGSETPGTSESATPESGPGSEPATSGSETPGTSESATPES GPGTSTEPSEGSAPGTSESATPESGPGSPAGSPTSTEEGSPAGSPTSTEEG SPAGSPTSTEEGTSESATPESGPGTSTEPSEGSAPGTSTEPSEGSPGSEP ATSGSETPGTSESATPESGPGSEPATSGSETPGTSESATPESGPGTSTEPS EGSAPGSPAGSPTSTEEGTSESATPESGPGSEPATSGSETPGTSESATPES GPGSPAGSPTSTEEGSPAGSPTSTEEGTSTEPSEGSAPGTSESATPESGPG TSESATPESGPGTSESATPESGPGSEPATSGSETPGSEPATSGSETPGSPA GSPTSTEEGTSTEPSEGSAPGTSTEPSEGSAPGSEPATSGSETPGTSESAT PESGPGTSTEPSEGSAPGSSS | |
| FVII(Gla-EGF2)-(R134-T179)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGRVSVSQTSK LTRAETVFPDVDYVNSTEAETILDNITQSTQSFNDFTRIVGGKVCPKGE CPWQVLLLVNGAQLCGGTLINTIWVVSAAHCFDKIKNWRNLIAVLGE HDLSEHDGDEQSRRVAQVIIPSTYVPGTTNHDIALLRLHQPVVLTDHV VPLCLPERTFSERTLAFVRFSLVSGWGQLLDRGATALELMVLNVPRLM TQDCLQQSRKVGDSPNITEYMFCAGYSDGSKDSCKGDSGGPHATHYR GTWYLTGIVSWGQGCATVGHFGVYTRVSQYIEWLQKLMRSEPRPGVL LRAPFP | 761 |
| FVII(Gla-EGF2)-(R134-T179)-FVII(Pro)-KLTRAET-AE288('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGRVSVSQTSK LTRAETVFPDVDYVNSTEAETILDNITQSTQSFNDFTRIVGGKVCPKGE CPWQVLLLVNGAQLCGGTLINTIWVVSAAHCFDKIKNWRNLIAVLGE HDLSEHDGDEQSRRVAQVIIPSTYVPGTTNHDIALLRLHQPVVLTDHV VPLCLPERTFSERTLAFVRFSLVSGWGQLLDRGATALELMVLNVPRLM TQDCLQQSRKVGDSPNITEYMFCAGYSDGSKDSCKGDSGGPHATHYR GTWYLTGIVSWGQGCATVGHFGVYTRVSQYIEWLQKLMRSEPRPGVL LRAPFPGPEGPSKLTRAETGTSESATPESGPGSEPATSGSETPGTSESATP ESGPGSEPATSGSETPGTSESATPESGPGTSTEPSEGSAPGSPAGSPTSTE EGTSESATPESGPGSEPATSGSETPGTSESATPESGPGSPAGSPTSTEEGS PAGSPTSTEEGTSTEPSEGSAPGTSESATPESGPGTSESATPESGPGTSES ATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAP | 762 |
| FVII(Gla-EGF2)-(R134-T179)-FVII(Pro)-KLTRAET-AE864('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGRVSVSQTSK LTRAETVFPDVDYVNSTEAETILDNITQSTQSFNDFTRIVGGKVCPKGE CPWQVLLLVNGAQLCGGTLINTIWVVSAAHCFDKIKNWRNLIAVLGE HDLSEHDGDEQSRRVAQVIIPSTYVPGTTNHDIALLRLHQPVVLTDHV VPLCLPERTFSERTLAFVRFSLVSGWGQLLDRGATALELMVLNVPRLM TQDCLQQSRKVGDSPNITEYMFCAGYSDGSKDSCKGDSGGPHATHYR GTWYLTGIVSWGQGCATVGHFGVYTRVSQYIEWLQKLMRSEPRPGVL LRAPFPGPEGPSKLTRAETGSPGSPAGSPTSTEEGTSESATPESGPGTSTE PSEGSAPGSPAGSPTSTEEGTSTEPSEGSAPGTSTEPSEGSAPGTSESATP ESGPGSEPATSGSETPGSEPATSGSETPGSPAGSPTSTEEGTSESATPESG PGTSTEPSEGSAPGTSTEPSEGSAPGSPAGSPTSTEEGTSTEPSEGSAPGT STEPSEGSAPGTSESATPESGPGTSTEPSEGSAPGTSESATPESGPGSEPA TSGSETPGTSTEPSEGSAPGTSTEPSEGSAPGTSESATPESGPGTSESATP ESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGT STEPSEGSAPGTSTEPSEGSAPGSPAGSPTSTEEGTSTEPSEGSAPGTSES ATPESGPGSEPATSGSETPGTSESATPESGPGSEPATSGSETPGTSESATP ESGPGTSTEPSEGSAPGTSESATPESGPGSPAGSPTSTEEGSPAGSPTSTE EGSPAGSPTSTEEGTSESATPESGPGTSTEPSEGSAPGTSESATPESGPGS EPATSGSETPGTSESATPESGPGSEPATSGSETPGTSESATPESGPGTSTE PSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESG PGTSESATPESGPGTSESATPESGPGSEPATSGSETPGSEPATSGSETPGS | 763 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| | PAGSPTSTEEGTSTEPSEGSAPGTSTEPSEGSAPGSEPATSGSETPGTSES ATPESGPGTSTEPSEGSAPGSSS | |
| FVII(Gla-EGF2)-(D177-V181)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKDFTRVVGGKVCPKGECPWQVLLLVNGAQLCGGTLINTIWVVSAAH CFDKIKNWRNLIAVLGEHDLSEHDGDEQSRRVAQVIIPSTYVPGTTNH DIALLRLHQPVVLTDHVVPLCLPERTFSERTLAFVRFSLVSGWGQLLDR GATALELMVLNVPRLMTQDCLQQSRKVGDSPNITEYMFCAGYSDGSK DSCKGDSGGPHATHYRGTWYLTGIVSWGQGCATVGHFGVYTRVSQYI EWLQKLMRSEPRPGVLLRAPFP | 764 |
| FVII(Gla-EGF2)-(D177-T179)-FVII(Pro)-KLTRAET-AE288('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKDFTRVVGGKVCPKGECPWQVLLLVNGAQLCGGTLINTIWVVSAAH CFDKIKNWRNLIAVLGEHDLSEHDGDEQSRRVAQVIIPSTYVPGTTNH DIALLRLHQPVVLTDHVVPLCLPERTFSERTLAFVRFSLVSGWGQLLDR GATALELMVLNVPRLMTQDCLQQSRKVGDSPNITEYMFCAGYSDGSK DSCKGDSGGPHATHYRGTWYLTGIVSWGQGCATVGHFGVYTRVSQYI EWLQKLMRSEPRPGVLLRAPFPGTSESATPESGPGSEPATSGSETPGTSE SATPESGPGSEPATSGSETPGTSESATPESGPGTSTEPSEGSAPGSPAGSP TSTEEGTSESATPESGPGSEPATSGSETPGTSESATPESGPGSPAGSPTST EEGSPAGSPTSTEEGTSTEPSEGSAPGTSESATPESGPGTSESATPESGPG TSESATPESGPGSEPATSGSETPGSEPATSGSETPGSPAGSPTSTEEGTST EPSEGSAPGTSTEPSEGSAPGSEPATSGSETPGTSESATPESGPGTSTEPS EGSAP | 765 |
| FVII(Gla-EGF2)-(D177-T179)-FVII(Pro)-KLTRAET-AE864('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVEYPCGKIPILEKRNA SKDFTRVVGGKVCPKGECPWQVLLLVNGAQLCGGTLINTIWVVSAAH CFDKIKNWRNLIAVLGEHDLSEHDGDEQSRRVAQVIIPSTYVPGTTNH DIALLRLHQPVVLTDHVVPLCLPERTFSERTLAFVRFSLVSGWGQLLDR GATALELMVLNVPRLMTQDCLQQSRKVGDSPNITEYMFCAGYSDGSK DSCKGDSGGPHATHYRGTWYLTGIVSWGQGCATVGHFGVYTRVSQYI EWLQKLMRSEPRPGVLLRAPFPGPEGPSKLTRAETGSPGSPAGSPTSTE EGTSESATPESGPGTSTEPSEGSAPGSPAGSPTSTEEGTSTEPSEGSAPGT STEPSEGSAPGTSESATPESGPGSEPATSGSETPGSEPATSGSETPGSPAG SPTSTEEGTSESATPESGPGTSTEPSEGSAPGTSTEPSEGSAPGSPAGSPT STEEGTSTEPSEGSAPGTSTEPSEGSAPGTSESATPESGPGTSTEPSEGSA PGTSESATPESGPGSEPATSGSETPGTSTEPSEGSAPGTSTEPSEGSAPGT SESATPESGPGTSESATPESGPGSPAGSPTSTEEGTSESATPESGPGSEPA TSGSETPGTSESATPESGPGTSTEPSEGSAPGTSTEPSEGSAPGTSTEPSE GSAPGTSTEPSEGSAPGTSTEPSEGSAPGTSTEPSEGSAPGSPAGSPTSTE EGTSTEPSEGSAPGTSESATPESGPGSEPATSGSETPGTSESATPESGPGS EPATSGSETPGTSESATPESGPGTSTEPSEGSAPGTSESATPESGPGSPAG SPTSTEEGSPAGSPTSTEEGSPAGSPTSTEEGTSESATPESGPGTSTEPSE GSAPGTSESATPESGPGSEPATSGSETPGTSESATPESGPGSEPATSGSET PGTSESATPESGPGTSTEPSEGSAPGTSESATPESGPGSPAGSPTSTEEGS PAGSPTSTEEGTSESATPESGPGSEPATSGSETPGSPAGSPTSTEEGTSTE PSEGSAPGTSESATPESGPGTSESATPESGPGSEPATSG SETPGSEPATSGSETPGSPAGSPTSTEEGTSTEPSEGSAPGTSTEPSEGSA PGSEPATSGSETPGTSESATPESGPGTSTEPSEGSAPGSSS | 766 |
| FVII(Gla-EGF2)-(K142-V181)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGKIPILEKRKL TRAETVFPDVDYVNSTEAETILDNITQSTQSFNDFTRVVGGKVCPKGEC PWQVLLLVNGAQLCGGTLINTIWVVSAAHCFDKIKNWRNLIAVLGEH DLSEHDGDEQSRRVAQVIIPSTYVPGTTNHDIALLRLHQPVVLTDHVVP LCLPERTFSERTLAFVRFSLVSGWGQLLDRGATALELMVLNVPRLMTQ DCLQQSRKVGDSPNITEYMFCAGYSDGSKDSCKGDSGGPHATHYRGT WYLTGIVSWGQGCATVGHFGVYTRVSQYIEWLQKLMRSEPRPGVLLR APFP | 767 |
| FVII(Gla-EGF2)-(K142-V181)-FVII(Pro)-KLTRAET-AE288('KLTRAET' disclosed as | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGKIPILEKRKL TRAETVFPDVDYVNSTEAETILDNITQSTQSFNDFTRVVGGKVCPKGEC PWQVLLLVNGAQLCGGTLINTIWVVSAAHCFDKIKNWRNLIAVLGEH DLSEHDGDEQSRRVAQVIIPSTYVPGTTNHDIALLRLHQPVVLTDHVVP | 768 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| SEQ ID NO: 6) | LCLPERTFSERTLAFVRFSLVSGWGQLLDRGATALELMVLNVPRLMTQ DCLQQSRKVGDSPNITEYMFCAGYSDGSKDSCKGDSGGPHATHYRGT WYLTGIVSWGQGCATVGHFGVYTRVSQYIEWLQKLMRSEPRPGVLLR APFPGPEGPSKLTRAETGTSESATPESGPGSEPATSGSETPGTSESATPES GPGSEPATSGSETPGTSESATPESGPGTSTEPSEGSAPGSPAGSPTSTEEG TSESATPESGPGSEPATSGSETPGTSESATPESGPGSPAGSPTSTEEGSPA GSPTSTEEGTSTEPSEGSAPGTSESATPESGPGTSESATPESGPGTSESAT PESGPGSEPATSGSETPGSEPATSGSETPGSPAGSPTSTEEGTSTEPSEGS APGTSTEPSEGSAPGSEPATSGSETPGTSESATPESGPGTSTEPSEGSAP | |
| FVII(Gla-EGF2)-(K142-V181)-FVII(Pro)-KLTRAET-AE864 ('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGKIPILEKRKL TRAETVFPDVDYVNSTEAETILDNITQSTQSFNDFTRVVGGKVCPKGEC PWQVLLLLVNGAQLCGGTLINTIWVVSAAHCFDKIKNWRNLIAVLGEH DLSEHDGDEQSRRVAQVIIPSTYVPGTTNHDIALLRLHQPVVLTDHVVP LCLPERTFSERTLAFVRFSLVSGWGQLLDRGATALELMVLNVPRLMTQ DCLQQSRKVGDSPNITEYMFCAGYSDGSKDSCKGDSGGPHATHYRGT WYLTGIVSWGQGCATVGHFGVYTRVSQYIEWLQKLMRSEPRPGVLLR APFPGPEGPSKLTRAETGSPGSPAGSPTSTEEGTSESATPESGPGTSTEPS EGSAPGSPAGSPTSTEEGTSTEPSEGSAPGTSTEPSEGSAPGTSESATPES GPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTST EPSEGSAPGTSESATPESGPGTSTEPSEGSAPGTSESATPESGPGSEPATS GSETPGTSTEPSEGSAPGTSTEPSEGSAPGTSESATPESGPGTSESATPES GPGSPAGSPTSTEEGTSESATPESGPGSEPATSGSETPGTSESATPESGPG TSTEPSEGSAPGTSTEPSEGSAPGTSTEPSEGSAPGTSESATPESGPGTST EPSEGSAPGTSTEPSEGSAPGSPAGSPTSTEEGTSTEPSEGSAPGTSESAT PESGPGSEPATSGSETPGSESATPESGPGSEPATSGSETPGTSESATPES GPGTSTEPSEGSAPGTSESATPESGPGSPAGSPTSTEEGSPAGSPTSTEEG SPAGSPTSTEEGTSESATPESGPGTSTEPSEGSAPGTSESATPESGPGSEP ATSGSETPGTSESATPESGPGSEPATSGSETPGSESATPESGPGTSTEPS EGSAPGSPAGSPTSTEEGTSESATPESGPGSEPATSGSETPGTSESATPES GPGSPAGSPTSTEEGSPAGSPTSTEEGTSTEPSEGSAPGTSESATPESGPG TSESATPESGPGTSESATPESGPGSEPATSGSETPGSEPATSGSETPGSPA GSPTSTEEGTSTEPSEGSAPGSEPATSGSETPGTSESAT PESGPGTSTEPSEGSAPGSSS | 769 |
| FVII(Gla-EGF2)-(R134-V181)-FVII(Pro) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGRVSVSQTSK LTRAETVFPDVDYVNSTEAETILDNITQSTQSFNDFTRVVGGKVCPKGE CPWQVLLLVNGAQLCGGTLINTIWVVSAAHCFDKIKNWRNLIAVLGE HDLSEHDGDEQSRRVAQVIIPSTYVPGTTNHDIALLRLHQPVVLTDHV VPLCLPERTFSERTLAFVRFSLVSGWGQLLDRGATALELMVLNVPRLM TQDCLQQSRKVGDSPNITEYMFCAGYSDGSKDSCKGDSGGPHATHYR GTWYLTGIVSWGQGCATVGHFGVYTRVSQYIEWLQKLMRSEPRPGVL LRAPFP | 770 |
| FVII(Gla-EGF2)-(R134-V181)-FVII(Pro)-KLTRAET-AE288 ('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGRVSVSQTSK LTRAETVFPDVDYVNSTEAETILDNITQSTQSFNDFTRVVGGKVCPKGE CPWQVLLLVNGAQLCGGTLINTIWVVSAAHCFDKIKNWRNLIAVLGE HDLSEHDGDEQSRRVAQVIIPSTYVPGTTNHDIALLRLHQPVVLTDHV VPLCLPERTFSERTLAFVRFSLVSGWGQLLDRGATALELMVLNVPRLM TQDCLQQSRKVGDSPNITEYMFCAGYSDGSKDSCKGDSGGPHATHYR GTWYLTGIVSWGQGCATVGHFGVYTRVSQYIEWLQKLMRSEPRPGVL LRAPFPGPEGPSKLTRAETGTSESATPESGPGSEPATSGSETPGTSESATP ESGPGSEPATSGSETPGTSESATPESGPGTSTEPSEGSAPGSPAGSPTSTE EGTSESATPESGPGSEPATSGSETPGTSESATPESGPGSPAGSPTSTEEGS PAGSPTSTEEGTSTEPSEGSAPGTSESATPESGPGTSESATPESGPGTSES ATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAP | 771 |
| FVII(Gla-EGF2)-(R134-V181)-FVII(Pro)-KLTRAET-AE864 ('KLTRAET' disclosed as SEQ ID NO: 6) | ANAFLEELRPGSLERECKEEQCSFEEAREIFKDAERTKLFWISYSDGDQ CASSPCQNGGSCKDQLQSYICFCLPAFEGRNCETHKDDQLICVNENGG CEQYCSDHTGTKRSCRCHEGYSLLADGVSCTPTVPFPCGRVSVSQTSK LTRAETVFPDVDYVNSTEAETILDNITQSTQSFNDFTRVVGGKVCPKGE CPWQVLLLVNGAQLCGGTLINTIWVVSAAHCFDKIKNWRNLIAVLGE HDLSEHDGDEQSRRVAQVIIPSTYVPGTTNHDIALLRLHQPVVLTDHV VPLCLPERTFSERTLAFVRFSLVSGWGQLLDRGATALELMVLNVPRLM TQDCLQQSRKVGDSPNITEYMFCAGYSDGSKDSCKGDSGGPHATHYR | 772 |

TABLE 43-continued

Exemplary FVII variants incorporating FIX AP sequence, cleavage sequences and XTEN**

| FVII Construct Name* | Amino Acid Sequence | SEQ ID NO: |
|---|---|---|
| | GTWYLTGIVSWGQGCATVGHFGVYTRVSQYIEWLQKLMRSEPRPGVL LRAPFPGPEGPSKLTRAETGSPGSPAGSPTSTEEGTSESATPESGPGTSTE PSEGSAPGSPAGSPTSTEEGTSTEPSEGSAPGTSTEPSEGSAPGTSESATP ESGPGSEPATSGSETPGSEPATSGSETPGSPAGSPTSTEEGTSESATPESG PGTSTEPSEGSAPGTSTEPSEGSAPGSPAGSPTSTEEGTSTEPSEGSAPGT STEPSEGSAPGTSESATPESGPGTSTEPSEGSAPGTSESATPESGPGSEPA TSGSETPGTSTEPSEGSAPGTSTEPSEGSAPGTSESATPESGPGTSESATP ESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGT STEPSEGSAPGTSTEPSEGSAPGSPAGSPTSTEEGTSTEPSEGSAPGTSES ATPESGPGSEPATSGSETPGTSESATPESGPGSEPATSGSETPGTSESATP ESGPGTSTEPSEGSAPGTSESATPESGPGSPAGSPTSTEEGSPAGSPTSTE EGSPAGSPTSTEEGTSESATPESGPGTSTEPSEGSAPGTSESATPESGPGS EPATSGSETPGTSESATPESGPGSEPATSGSETPGTSESATPESGPGTSTE PSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESG PGTSESATPESGPGTSESATPESGPGSEPATSGSETPGSEPATSGSETPGS PAGSPTSTEEGTSTEPSEGSAPGTSTEPSEGSAPGSEPATSGSETPGTSES ATPESGPGTSTEPSEGSAPGSSS | |

*Sequence name reflects N- to C-terminus configuration of the FVII variant (Gla-EGF2 domains), FIX AP cleavage sequence, FVII protease domain, XTEN cleavage sequence and XTEN components (the latter when included)
**Not all sequences incorporate XTEN

SEQUENCE LISTING (786 sequences)

SEQ ID NO: 1 - protein, 52 aa, Homo sapiens
RVSVSQTSKLTRAETVFPDVDYVNSTEAETILDNITQSTQSFNDFTRVVGGE

SEQ ID NO: 2 - protein, 40 aa, Homo sapiens
KLTRAETVFPDVDYVNSTEAETILDNITQSTQSFNDFTRV

SEQ ID NO: 3 - protein, 12 aa, Homo sapiens
TSKLTRAETVFP

SEQ ID NO: 4 - protein, 5 aa, Homo sapiens
DFTRV

SEQ ID NO: 5 - protein, 7 aa, Homo sapiens
FNDFTRV

SEQ ID NO: 6 - protein, 7 aa, Homo sapiens
KLTRAET

SEQ ID NO: 7 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 8 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 9 - protein, 460 aa, Artificial Sequence
  Description of Artificial Sequence: Synthetic recombinant blood coagulation factor IX (rFIX) mutant FIX-Y94F/K98T
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 10 - protein, 460 aa, Artificial Sequence
  Description of Artificial Sequence: Synthetic recombinant blood coagulation factor IX (rFIX) mutant FIX-Y94F/K98T/Y177F
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVNSYVTPICIADKEYTNIFLKFGSGYVSGWGRVFHKGRSALVLQYLRVPLVDRATCLRSTKFTIFNNMFCAGFHEGGRDSCQGDSGGPHVTEVEGTSFLTGIISWGEECAMKGKYGIYTKVSRYVNWIKEKTKLT

SEQ ID NO: 11 - protein, 460 aa, Artificial Sequence
  Description of Artificial Sequence: Synthetic recombinant blood coagulation factor IX (rFIX) mutant FIX-Y94F/K98T/Y177F/I213V/E219G
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVLNSYVTPICIADKEYTNIFLKFGSGYVSGWGRVFHKGRSALVLQYLRVPLVDATCLRSTKFTIFNNMFCAGFHEGGRDSCQGDSGGPHVTEVEGTSFLTGIVSWGEGCAMKGKYGIYTKVSRYVNWIKEKTKLT

SEQ ID NO: 12 - protein, 462 aa, Homo sapiens
MQRVNMIMAESPSLITICLLGYLLSAECTVFLDHENANKILNRPKRYNSGKLEEFVQGNLERECMEEKCSFEEPREVFENTEKITEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNPTEAETILDNITQGTQSFNDFTRVVGGEDAKPGQFPWQVVLNGKVDAFCGGSIVNEKWIVTAAHCVETGVKITVVAGEHNIEETEHTEQKRNVIRAIIPHHNYNAAINKYNHDIALLELDEPLVLNSYVTPICIADKEYTNIFLKFGSGYVSGWARVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 13 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 14 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 15 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 16 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 17 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 18 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 19 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 20 - protein, 444 aa, Homo sapiens
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 21 - protein, 406 aa, Homo sapiens [sequence omitted]

SEQ ID NO: 22 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKSLTRNGPLKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 23 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKSMTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 24 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKCGQRLRKSKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 25 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKIKPRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 26 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKKLTRAETVKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 27 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 28 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKIQIRSVAKKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 29 - protein, 405 aa, Artificial Sequence
  Description of Artificial Sequence: Synthetic polypeptide
NAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 30 - protein, 406 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKIEPRSPSQKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 31 - protein, 12 aa, Artificial Sequence
  Description of Artificial Sequence: Synthetic peptide
GESPGGSSGSES

SEQ ID NO: 32 - protein, 12 aa, Artificial Sequence
  Description of Artificial Sequence: Synthetic peptide
GSEGSSGPGESS

SEQ ID NO: 33 - protein, 12 aa, Artificial Sequence
  Description of Artificial Sequence: Synthetic peptide
GSSESGSSEGGP

SEQ ID NO: 34 - protein, 12 aa, Artificial Sequence
  Description of Artificial Sequence: Synthetic peptide
GSGGEPSESGSS

SEQ ID NO: 35 - protein, 12 aa, Artificial Sequence
  Description of Artificial Sequence: Synthetic peptide
GSPAGSPTSTEE

SEQ ID NO: 36 - protein, 12 aa, Artificial Sequence
  Description of Artificial Sequence: Synthetic peptide
GSEPATSGSETP

SEQ ID NO: 37 - protein, 12 aa, Artificial Sequence
  Description of Artificial Sequence: Synthetic peptide
GTSESATPESGP

SEQ ID NO: 38 - protein, 12 aa, Artificial Sequence
  Description of Artificial Sequence: Synthetic peptide
GTSTEPSEGSAP

SEQ ID NO: 39 - protein, 12 aa, Artificial Sequence
  Description of Artificial Sequence: Synthetic peptide
GSTSESPSGTAP

SEQ ID NO: 40 - protein, 12 aa, Artificial Sequence
  Description of Artificial Sequence: Synthetic peptide
GTSTPESGSASP

SEQ ID NO: 41 - protein, 12 aa, Artificial Sequence
  Description of Artificial Sequence: Synthetic peptide
GTSPSGESSTAP

SEQ ID NO: 42 - protein, 12 aa, Artificial Sequence
  Description of Artificial Sequence: Synthetic peptide
GSTSSTAESPGP

SEQ ID NO: 43 - protein, 12 aa, Artificial Sequence
  Description of Artificial Sequence: Synthetic peptide
GTPGSGTASSSP

SEQ ID NO: 44 - protein, 12 aa, Artificial Sequence
  Description of Artificial Sequence: Synthetic peptide
GSSTPSGATGSP

SEQ ID NO: 45 - protein, 12 aa, Artificial Sequence
  Description of Artificial Sequence: Synthetic peptide
GSSPSASTGTGP

SEQ ID NO: 46 - protein, 12 aa, Artificial Sequence
  Description of Artificial Sequence: Synthetic peptide
GASPGTSSTGSP

SEQ ID NO: 47 - protein, 12 aa, Artificial Sequence
  Description of Artificial Sequence: Synthetic peptide
GEPAGSPTSTSE

SEQ ID NO: 48 - protein, 12 aa, Artificial Sequence
  Description of Artificial Sequence: Synthetic peptide
GTGEPSSTPASE

SEQ ID NO: 49 - protein, 12 aa, Artificial Sequence
  Description of Artificial Sequence: Synthetic peptide
GSGPSTESAPTE

SEQ ID NO: 50 - protein, 12 aa, Artificial Sequence
  Description of Artificial Sequence: Synthetic peptide
GSETPSGPSETA

SEQ ID NO: 51 - protein, 12 aa, Artificial Sequence
  Description of Artificial Sequence: Synthetic peptide
GPSETSTSEPGA

SEQ ID NO: 52 - protein, 12 aa, Artificial Sequence
  Description of Artificial Sequence: Synthetic peptide
GSPSEPTEGTSA

SEQ ID NO: 53 - protein, 12 aa, Artificial Sequence
  Description of Artificial Sequence: Synthetic peptide
GSGASEPTSTEP

SEQ ID NO: 54 - protein, 12 aa, Artificial Sequence
  Description of Artificial Sequence: Synthetic peptide
GSEPATSGTEPS

SEQ ID NO: 55 - protein, 12 aa, Artificial Sequence
  Description of Artificial Sequence: Synthetic peptide
GTSEPSTSEPGA

SEQ ID NO: 56 - protein, 12 aa, Artificial Sequence
  Description of Artificial Sequence: Synthetic peptide
GTSTEPSEPGSA

SEQ ID NO: 57 - protein, 12 aa, Artificial Sequence
  Description of Artificial Sequence: Synthetic peptide
GSTAGSETSTEA

SEQ ID NO: 58 - protein, 12 aa, Artificial Sequence
  Description of Artificial Sequence: Synthetic peptide
GSETATSGSETA

SEQ ID NO: 59 - protein, 12 aa, Artificial Sequence
  Description of Artificial Sequence: Synthetic peptide
GTSESATSESGA

SEQ ID NO: 60 - protein, 12 aa, Artificial Sequence
  Description of Artificial Sequence: Synthetic peptide
GTSTEASEGSAS

SEQ ID NO: 61 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 62 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 63 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 64 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 65 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 66 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 67 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 68 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 69 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 70 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 71 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 72 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 73 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 74 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 75 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 76 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 77 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 78 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 79 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 80 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 81 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 82 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 83 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 84 - protein, 31 aa, Homo sapiens
TVFPDVDYVNSTEAETILDNITQSTQSFNDF

SEQ ID NO: 85 - protein, 12 aa, Homo sapiens
FNDFTRVVGGED

SEQ ID NO: 86 - protein, 8 aa, Artificial Sequence
  Description of Artificial Sequence: Synthetic peptide
LTPRSLLV

SEQ ID NO: 87 - protein, 7 aa, Artificial Sequence
  Description of Artificial Sequence: Synthetic peptide
KLTRAET

SEQ ID NO: 88 - protein, 7 aa, Artificial Sequence
  Description of Artificial Sequence: Synthetic peptide
DFTRVVG

SEQ ID NO: 89 - protein, 8 aa, Artificial Sequence
  Description of Artificial Sequence: Synthetic peptide
TMTRIVGG

SEQ ID NO: 90 - protein, 8 aa, Artificial Sequence
  Description of Artificial Sequence: Synthetic peptide
SPFRSTGG

SEQ ID NO: 91 - protein, 8 aa, Artificial Sequence
  Description of Artificial Sequence: Synthetic peptide
LQVRIVGG

SEQ ID NO: 92 - protein, 8 aa, Artificial Sequence
  Description of Artificial Sequence: Synthetic peptide
PLGRIVGG

SEQ ID NO: 93 - protein, 8 aa, Artificial Sequence
  Description of Artificial Sequence: Synthetic peptide
IEGRTVGG

SEQ ID NO: 94 - protein, 8 aa, Artificial Sequence
  Description of Artificial Sequence: Synthetic peptide
LTPRSLLV

SEQ ID NO: 95 - protein, 8 aa, Artificial Sequence
  Description of Artificial Sequence: Synthetic peptide
LGPVSGVP

SEQ ID NO: 96 - protein, 8 aa, Artificial Sequence
  Description of Artificial Sequence: Synthetic peptide
VAGDSLEE

SEQ ID NO: 97 - protein, 8 aa, Artificial Sequence
  Description of Artificial Sequence: Synthetic peptide
GPAGLGGA

SEQ ID NO: 98 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 99 - protein, 8 aa, Artificial Sequence
  Description of Artificial Sequence: Synthetic peptide
GPAGLRGA

SEQ ID NO: 100 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 101 - protein, 8 aa, Artificial Sequence
  Description of Artificial Sequence: Synthetic peptide
APLGLRLR

SEQ ID NO: 102 - protein, 8 aa, Artificial Sequence
  Description of Artificial Sequence: Synthetic peptide
PALPLVAQ

SEQ ID NO: 103 - protein, 7 aa, Artificial Sequence
  Description of Artificial Sequence: Synthetic peptide
ENLYFQG

SEQ ID NO: 104 - protein, 8 aa, Artificial Sequence
  Description of Artificial Sequence: Synthetic peptide
ENLYFQGS

SEQ ID NO: 105 - protein, 8 aa, Artificial Sequence
  Description of Artificial Sequence: Synthetic peptide
DDDKIVGG

SEQ ID NO: 106 - protein, 8 aa, Artificial Sequence
  Description of Artificial Sequence: Synthetic peptide
DDDKIVGG

SEQ ID NO: 107 - protein, 8 aa, Artificial Sequence
  Description of Artificial Sequence: Synthetic peptide
LEVLFQGP

SEQ ID NO: 108 - protein, 8 aa, Artificial Sequence
  Description of Artificial Sequence: Synthetic peptide
LEVLFQGP

SEQ ID NO: 109 - protein, 8 aa, Artificial Sequence
  Description of Artificial Sequence: Synthetic peptide
LPKTGSES

SEQ ID NO: 110 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 111 - DNA, 144 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttct

SEQ ID NO: 112 - DNA, 144 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctct

SEQ ID NO: 113 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 114 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 115 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 116 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 117 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 118 - DNA, 1875 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 119 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 120 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 121 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 122 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 123 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 124 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 125 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 126 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 127 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 128 - DNA, 37 bp, Artificial Sequence
  Description of Artificial Sequence: Synthetic oligonucleotide
aggtgcaagcgcaagcggcgcgccaagcacgggaggt

SEQ ID NO: 129 - DNA, 37 bp, Artificial Sequence
  Description of Artificial Sequence: Synthetic oligonucleotide
aggtccagaaccaacggggccggccccaagcggaggt

SEQ ID NO: 130 - DNA, 147 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctcca

SEQ ID NO: 131 - DNA, 147 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctcca

SEQ ID NO: 132 - DNA, 36 bp, Artificial Sequence
  Description of Artificial Sequence: Synthetic oligonucleotide
aggtgaatctccdggtggytcyagcggttcygartc

SEQ ID NO: 133 - DNA, 36 bp, Artificial Sequence
  Description of Artificial Sequence: Synthetic oligonucleotide
acctgaytcrgaaccgctrgarccacchggagattc

SEQ ID NO: 134 - DNA, 36 bp, Artificial Sequence
  Description of Artificial Sequence: Synthetic oligonucleotide
aggtagcgaaggttcttcyggtccdggygartcytc

SEQ ID NO: 135 - DNA, 36 bp, Artificial Sequence
  Description of Artificial Sequence: Synthetic oligonucleotide
acctgargaytcrcchggaccrgaagaaccttcgct

SEQ ID NO: 136 - DNA, 36 bp, Artificial Sequence
  Description of Artificial Sequence: Synthetic oligonucleotide
aggttcytcygaaagcggttcttcygarggyggtcc

SEQ ID NO: 137 - DNA, 36 bp, Artificial Sequence
  Description of Artificial Sequence: Synthetic oligonucleotide
acctggaccrccytcrgaagaaccgctttcrgarga

SEQ ID NO: 138 - DNA, 36 bp, Artificial Sequence
  Description of Artificial Sequence: Synthetic oligonucleotide
aggttcyggtggygaaccdtcygartctggtagctc

SEQ ID NO: 139 - DNA, 24 bp, Artificial Sequence
  Description of Artificial Sequence: Synthetic oligonucleotide
aggttcgtcttcactcgagggtac

SEQ ID NO: 140 - DNA, 16 bp, Artificial Sequence
  Description of Artificial Sequence: Synthetic oligonucleotide
cctcgagtgaagacga

SEQ ID NO: 141 - protein, 36 aa, Artificial Sequence
  Description of Artificial Sequence: Synthetic polypeptide
GSGGEPSESGSSGESPGGSSGSESGESPGGSSGSES

SEQ ID NO: 142 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 143 - protein, 36 aa, Artificial Sequence
  Description of Artificial Sequence: Synthetic polypeptide
GSEGSSGPGESSGESPGGSSGSESGSSESGSSEGGP

SEQ ID NO: 144 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 145 - protein, 36 aa, Artificial Sequence
  Description of Artificial Sequence: Synthetic polypeptide
GSSESGSSEGGPGSSESGSSEGGPGESPGGSSGSES

SEQ ID NO: 146 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 147 - protein, 36 aa, Artificial Sequence
  Description of Artificial Sequence: Synthetic polypeptide
GSGGEPSESGSSGSSESGSSEGGPGSGGEPSESGSS

SEQ ID NO: 148 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 149 - protein, 36 aa, Artificial Sequence
  Description of Artificial Sequence: Synthetic polypeptide
GSSESGSSEGGPGSEGSSGPGESSGSEGSSGPGESS

SEQ ID NO: 150 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 151 - protein, 36 aa, Artificial Sequence
  Description of Artificial Sequence: Synthetic polypeptide
GSSESGSSEGGPGESPGGSSGSESGSEGSSGPGESS

SEQ ID NO: 152 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 153 - protein, 36 aa, Artificial Sequence
  Description of Artificial Sequence: Synthetic polypeptide
GSGGEPSESGSSGSGGEPSESGSSGSEGSSGPGESS

SEQ ID NO: 154 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 155 - protein, 36 aa, Artificial Sequence
  Description of Artificial Sequence: Synthetic polypeptide
GSSESGSSEGGPGSEGSSGPGESSGESPGGSSGSES

SEQ ID NO: 156 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 157 - protein, 36 aa, Artificial Sequence
  Description of Artificial Sequence: Synthetic polypeptide
GSSESGSSEGGPGSSESGSSEGGPGSSESGSSEGGP

SEQ ID NO: 158 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 159 - protein, 36 aa, Artificial Sequence
  Description of Artificial Sequence: Synthetic polypeptide
GSGGEPSESGSSGSEGSSGPGESSGSSESGSSEGGP

SEQ ID NO: 160 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 161 - protein, 36 aa, Artificial Sequence; identical to SEQ ID NO: 147
  Description of Artificial Sequence: Synthetic polypeptide

SEQ ID NO: 162 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 163 - protein, 36 aa, Artificial Sequence
  Description of Artificial Sequence: Synthetic polypeptide
GSGGEPSESGSSGSSESGSSEGGPGESPGGSSGSES

SEQ ID NO: 164 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 165 - protein, 36 aa, Artificial Sequence
  Description of Artificial Sequence: Synthetic polypeptide
GSGGEPSESGSSGESPGGSSGSESGSEGSSGPGESS

SEQ ID NO: 166 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 167 - protein, 36 aa, Artificial Sequence
  Description of Artificial Sequence: Synthetic polypeptide
GSGGEPSESGSSGESPGGSSGSESGSGGEPSESGSS

SEQ ID NO: 168 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 169 - protein, 36 aa, Artificial Sequence; identical to SEQ ID NO: 157
  Description of Artificial Sequence: Synthetic polypeptide

SEQ ID NO: 170 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 171 - protein, 36 aa, Artificial Sequence
  Description of Artificial Sequence: Synthetic polypeptide
GESPGGSSGSESGSEGSSGPGESSGSEGSSGPGESS

SEQ ID NO: 172 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 173 - protein, 36 aa, Artificial Sequence
  Description of Artificial Sequence: Synthetic polypeptide
GSGGEPSESGSSGSGGEPSESGSSGSSESGSSEGGP

SEQ ID NO: 174 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 175 - protein, 36 aa, Artificial Sequence
  Description of Artificial Sequence: Synthetic polypeptide
GSGGEPSESGSSGSGGEPSESGSSGSGGEPSESGSS

SEQ ID NO: 176 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 177 - protein, 36 aa, Artificial Sequence
  Description of Artificial Sequence: Synthetic polypeptide
GSGGEPSESGSSGSSESGSSEGGPGSEGSSGPGESS

SEQ ID NO: 178 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 179 - protein, 36 aa, Artificial Sequence
  Description of Artificial Sequence: Synthetic polypeptide
GSGGEPSESGSSGSEGSSGPGESSGSGGEPSESGSS

SEQ ID NO: 180 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 181 - protein, 36 aa, Artificial Sequence; identical to SEQ ID NO: 167
  Description of Artificial Sequence: Synthetic polypeptide

SEQ ID NO: 182 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 183 - protein, 36 aa, Artificial Sequence
  Description of Artificial Sequence: Synthetic polypeptide
GSSESGSSEGGPGSGGEPSESGSSGSSESGSSEGGP

SEQ ID NO: 184 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 185 - protein, 36 aa, Artificial Sequence
  Description of Artificial Sequence: Synthetic polypeptide
GSEGSSGPGESSGESPGGSSGSESGSEGSSGPGESS

SEQ ID NO: 186 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 187 - protein, 36 aa, Artificial Sequence; identical to SEQ ID NO: 157
  Description of Artificial Sequence: Synthetic polypeptide

SEQ ID NO: 188 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 189 - protein, 36 aa, Artificial Sequence; identical to SEQ ID NO: 141
  Description of Artificial Sequence: Synthetic polypeptide

SEQ ID NO: 190 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 191 - protein, 36 aa, Artificial Sequence
  Description of Artificial Sequence: Synthetic polypeptide
GSGGEPSESGSSGSEGSSGPGESSGESPGGSSGSES

SEQ ID NO: 192 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 193 - protein, 36 aa, Artificial Sequence
  Description of Artificial Sequence: Synthetic polypeptide
GESPGGSSGSESGESPGGSSGSESGESPGGSSGSES

SEQ ID NO: 194 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 195 - protein, 36 aa, Artificial Sequence
  Description of Artificial Sequence: Synthetic polypeptide
GSEGSSGPGESSGSEGSSGPGESSGSGGEPSESGSS

SEQ ID NO: 196 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 197 - protein, 36 aa, Artificial Sequence; identical to SEQ ID NO: 191
  Description of Artificial Sequence: Synthetic polypeptide

SEQ ID NO: 198 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 199 - protein, 36 aa, Artificial Sequence; identical to SEQ ID NO: 147
  Description of Artificial Sequence: Synthetic polypeptide

SEQ ID NO: 200 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 201 - protein, 36 aa, Artificial Sequence
  Description of Artificial Sequence: Synthetic polypeptide
GSSESGSSEGGPGSGGEPSESGSSGSEGSSGPGESS

SEQ ID NO: 202 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 203 - protein, 36 aa, Artificial Sequence
  Description of Artificial Sequence: Synthetic polypeptide
GSGGEPSESGSSGSEGSSGPGESSGSEGSSGPGESS

SEQ ID NO: 204 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 205 - protein, 36 aa, Artificial Sequence; identical to SEQ ID NO: 147
  Description of Artificial Sequence: Synthetic polypeptide

SEQ ID NO: 206 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 207 - protein, 36 aa, Artificial Sequence; identical to SEQ ID NO: 141
  Description of Artificial Sequence: Synthetic polypeptide

SEQ ID NO: 208 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 209 - protein, 36 aa, Artificial Sequence
  Description of Artificial Sequence: Synthetic polypeptide
GSGGEPSESGSSGSGGEPSESGSSGESPGGSSGSES

SEQ ID NO: 210 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 211 - protein, 36 aa, Artificial Sequence
  Description of Artificial Sequence: Synthetic polypeptide
GSEGSSGPGESSGSSESGSSEGGPGSEGSSGPGESS

SEQ ID NO: 212 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 213 - protein, 36 aa, Artificial Sequence
  Description of Artificial Sequence: Synthetic polypeptide
GSSESGSSEGGPGESPGGSSGSESGESPGGSSGSES

SEQ ID NO: 214 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 215 - protein, 36 aa, Artificial Sequence; identical to SEQ ID NO: 195
  Description of Artificial Sequence: Synthetic polypeptide

SEQ ID NO: 216 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 217 - DNA, 36 bp, Artificial Sequence
  Description of Artificial Sequence: Synthetic oligonucleotide
aggtagcccdgcwggytctccdacytcyacygarga

SEQ ID NO: 218 - DNA, 36 bp, Artificial Sequence
  Description of Artificial Sequence: Synthetic oligonucleotide
accttcytcrgtrgargthggagarccwgchgggct

SEQ ID NO: 219 - DNA, 36 bp, Artificial Sequence
  Description of Artificial Sequence: Synthetic oligonucleotide
aggtagcgaacckgcwacytcyggytctgaracycc

SEQ ID NO: 220 - DNA, 36 bp, Artificial Sequence
  Description of Artificial Sequence: Synthetic oligonucleotide
acctggrgtytcagarccrgargtwgcmggttcgct

SEQ ID NO: 221 - DNA, 36 bp, Artificial Sequence
  Description of Artificial Sequence: Synthetic oligonucleotide
aggtacytctgaaagcgcwacycckgartcyggycc

SEQ ID NO: 222 - DNA, 36 bp, Artificial Sequence
  Description of Artificial Sequence: Synthetic oligonucleotide
acctggrccrgaytcmggrgtwgcgctttcagargt

SEQ ID NO: 223 - DNA, 36 bp, Artificial Sequence
  Description of Artificial Sequence: Synthetic oligonucleotide
aggtacytctacygaaccktcygarggyagcgcwcc

SEQ ID NO: 224 - DNA, 36 bp, Artificial Sequence
  Description of Artificial Sequence: Synthetic oligonucleotide
acctggwgcgctrccytcrgamggttcrgtagargt

SEQ ID NO: 225 - protein, 36 aa, Artificial Sequence
  Description of Artificial Sequence: Synthetic polypeptide
GSPAGSPTSTEEGTSESATPESGPGTSTEPSEGSAP

SEQ ID NO: 226 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 227 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 228 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 229 - protein, 36 aa, Artificial Sequence
  Description of Artificial Sequence: Synthetic polypeptide
GTSTEPSEGSAPGTSESATPESGPGTSESATPESGP

SEQ ID NO: 230 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 231 - protein, 36 aa, Artificial Sequence; identical to SEQ ID NO: 229
  Description of Artificial Sequence: Synthetic polypeptide

SEQ ID NO: 232 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 233 - protein, 36 aa, Artificial Sequence
  Description of Artificial Sequence: Synthetic polypeptide
GSEPATSGSETPGTSESATPESGPGSPAGSPTSTEE

SEQ ID NO: 234 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 235 - protein, 36 aa, Artificial Sequence
  Description of Artificial Sequence: Synthetic polypeptide
GTSESATPESGPGSEPATSGSETPGTSTEPSEGSAP

SEQ ID NO: 236 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 237 - protein, 36 aa, Artificial Sequence
  Description of Artificial Sequence: Synthetic polypeptide
GSPAGSPTSTEEGSPAGSPTSTEEGSEPATSGSETP

SEQ ID NO: 238 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 239 - protein, 36 aa, Artificial Sequence; identical to SEQ ID NO: 225
  Description of Artificial Sequence: Synthetic polypeptide

SEQ ID NO: 240 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 241 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 242 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 243 - protein, 36 aa, Artificial Sequence
  Description of Artificial Sequence: Synthetic polypeptide
GTSESATPESGPGTSTEPSEGSAPGTSTEPSEGSAP

SEQ ID NO: 244 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 245 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 246 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 247 - protein, 36 aa, Artificial Sequence
  Description of Artificial Sequence: Synthetic polypeptide
GSEPATSGSETPGSPAGSPTSTEEGTSESATPESGP

SEQ ID NO: 248 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 249 - protein, 36 aa, Artificial Sequence; identical to SEQ ID NO: 229
  Description of Artificial Sequence: Synthetic polypeptide

SEQ ID NO: 250 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 251 - protein, 36 aa, Artificial Sequence
  Description of Artificial Sequence: Synthetic polypeptide
GTSTEPSEGSAPGSEPATSGSETPGSPAGSPTSTEE

SEQ ID NO: 252 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 253 - protein, 36 aa, Artificial Sequence
  Description of Artificial Sequence: Synthetic polypeptide
GSPAGSPTSTEEGTSESATPESGPGSEPATSGSETP

SEQ ID NO: 254 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 255 - protein, 36 aa, Artificial Sequence
  Description of Artificial Sequence: Synthetic polypeptide
GTSESATPESGPGSPAGSPTSTEEGSPAGSPTSTEE

SEQ ID NO: 256 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 257 - protein, 36 aa, Artificial Sequence
  Description of Artificial Sequence: Synthetic polypeptide
GTSTEPSEGSAPGTSESATPESGPGTSTEPSEGSAP

SEQ ID NO: 258 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 259 - protein, 36 aa, Artificial Sequence
  Description of Artificial Sequence: Synthetic polypeptide
GSPAGSPTSTEEGTSTEPSEGSAPGSEPATSGSETP

SEQ ID NO: 260 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 261 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 262 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 263 - protein, 36 aa, Artificial Sequence; identical to SEQ ID NO: 233
  Description of Artificial Sequence: Synthetic polypeptide

SEQ ID NO: 264 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 265 - protein, 36 aa, Artificial Sequence; identical to SEQ ID NO: 243
  Description of Artificial Sequence: Synthetic polypeptide

SEQ ID NO: 266 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 267 - protein, 36 aa, Artificial Sequence; identical to SEQ ID NO: 261
  Description of Artificial Sequence: Synthetic polypeptide

SEQ ID NO: 268 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 269 - protein, 36 aa, Artificial Sequence; identical to SEQ ID NO: 227
  Description of Artificial Sequence: Synthetic polypeptide

SEQ ID NO: 270 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 271 - protein, 36 aa, Artificial Sequence
  Description of Artificial Sequence: Synthetic polypeptide
GSEPATSGSETPGTSESATPESGPGTSTEPSEGSAP

SEQ ID NO: 272 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 273 - protein, 36 aa, Artificial Sequence; identical to SEQ ID NO: 245
  Description of Artificial Sequence: Synthetic polypeptide

SEQ ID NO: 274 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 275 - protein, 36 aa, Artificial Sequence
  Description of Artificial Sequence: Synthetic polypeptide
GSEPATSGSETPGTSESATPESGPGSEPATSGSETP

SEQ ID NO: 276 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 277 - protein, 36 aa, Artificial Sequence; identical to SEQ ID NO: 275
  Description of Artificial Sequence: Synthetic polypeptide

SEQ ID NO: 278 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 279 - protein, 36 aa, Artificial Sequence
  Description of Artificial Sequence: Synthetic polypeptide
GSEPATSGSETPGSEPATSGSETPGTSTEPSEGSAP

SEQ ID NO: 280 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 281 - protein, 36 aa, Artificial Sequence
  Description of Artificial Sequence: Synthetic polypeptide
GTSESATPESGPGSEPATSGSETPGSEPATSGSETP

SEQ ID NO: 282 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 283 - protein, 36 aa, Artificial Sequence
  Description of Artificial Sequence: Synthetic polypeptide
GTSTEPSEGSAPGTSTEPSEGSAPGTSESATPESGP

SEQ ID NO: 284 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 285 - protein, 36 aa, Artificial Sequence
  Description of Artificial Sequence: Synthetic polypeptide
GSEPATSGSETPGTSESATPESGPGTSESATPESGP

SEQ ID NO: 286 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 287 - protein, 36 aa, Artificial Sequence; identical to SEQ ID NO: 279
  Description of Artificial Sequence: Synthetic polypeptide

SEQ ID NO: 288 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 289 - protein, 36 aa, Artificial Sequence
  Description of Artificial Sequence: Synthetic polypeptide
GSEPATSGSETPGTSTEPSEGSAPGSEPATSGSETP

SEQ ID NO: 290 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 291 - protein, 36 aa, Artificial Sequence
  Description of Artificial Sequence: Synthetic polypeptide
GTSTEPSEGSAPGTSTEPSEGSAPGSEPATSGSETP

SEQ ID NO: 292 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 293 - protein, 36 aa, Artificial Sequence; identical to SEQ ID NO: 251
  Description of Artificial Sequence: Synthetic polypeptide

SEQ ID NO: 294 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 295 - protein, 36 aa, Artificial Sequence; identical to SEQ ID NO: 247
  Description of Artificial Sequence: Synthetic polypeptide

SEQ ID NO: 296 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 297 - protein, 36 aa, Artificial Sequence
  Description of Artificial Sequence: Synthetic polypeptide
GTSESATPESGPGSEPATSGSETPGTSESATPESGP

SEQ ID NO: 298 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 299 - DNA, 36 bp, Artificial Sequence
  Description of Artificial Sequence: Synthetic oligonucleotide
aggttctacyagcgaatcyccktctggyacygcwcc

SEQ ID NO: 300 - DNA, 36 bp, Artificial Sequence
  Description of Artificial Sequence: Synthetic oligonucleotide
acctggwgcrgtrccagamggrgattcgctrgtaga

SEQ ID NO: 301 - DNA, 36 bp, Artificial Sequence
  Description of Artificial Sequence: Synthetic oligonucleotide
aggtacytctacycckgaaagcggytcygcwtctcc

SEQ ID NO: 302 - DNA, 36 bp, Artificial Sequence
  Description of Artificial Sequence: Synthetic oligonucleotide
acctggagawgcrgarccgctttcmggrgtagargt

SEQ ID NO: 303 - DNA, 36 bp, Artificial Sequence
  Description of Artificial Sequence: Synthetic oligonucleotide
aggtacytcycckagcggygaatcttctacygcwcc

SEQ ID NO: 304 - DNA, 36 bp, Artificial Sequence
  Description of Artificial Sequence: Synthetic oligonucleotide
acctggwgcrgtagaagattcrccgctmggrgargt

SEQ ID NO: 305 - DNA, 36 bp, Artificial Sequence
  Description of Artificial Sequence: Synthetic oligonucleotide
aggttcyacyagctctacygcwgaatctcckggycc

SEQ ID NO: 306 - DNA, 36 bp, Artificial Sequence
  Description of Artificial Sequence: Synthetic oligonucleotide
acctggrccmggagattcwgcrgtagagctrgtrga

SEQ ID NO: 307 - protein, 36 aa, Artificial Sequence
  Description of Artificial Sequence: Synthetic polypeptide
GTSTPESGSASPGTSPSGESSTAPGTSPSGESSTAP

SEQ ID NO: 308 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 309 - protein, 36 aa, Artificial Sequence
  Description of Artificial Sequence: Synthetic polypeptide
GTSPSGESSTAPGSTSSTAESPGPGTSPSGESSTAP

SEQ ID NO: 310 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 311 - protein, 36 aa, Artificial Sequence
  Description of Artificial Sequence: Synthetic polypeptide
GSTSSTAESPGPGTSPSGESSTAPGTSTPESGSASP

SEQ ID NO: 312 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 313 - protein, 36 aa, Artificial Sequence
  Description of Artificial Sequence: Synthetic polypeptide
GSTSSTAESPGPGSTSSTAESPGPGTSPSGESSTAP

SEQ ID NO: 314 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 315 - protein, 36 aa, Artificial Sequence; identical to SEQ ID NO: 311
  Description of Artificial Sequence: Synthetic polypeptide

SEQ ID NO: 316 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 317 - protein, 36 aa, Artificial Sequence
  Description of Artificial Sequence: Synthetic polypeptide
GSTSSTAESPGPGTSTPESGSASPGSTSESPSGTAP

SEQ ID NO: 318 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 319 - protein, 36 aa, Artificial Sequence
  Description of Artificial Sequence: Synthetic polypeptide
GSTSSTAESPGPGTSTPESGSASPGTSTPESGSASP

SEQ ID NO: 320 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 321 - protein, 36 aa, Artificial Sequence
  Description of Artificial Sequence: Synthetic polypeptide
GSTSESPSGTAPGTSPSGESSTAPGSTSESPSGTAP

SEQ ID NO: 322 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 323 - protein, 36 aa, Artificial Sequence; identical to SEQ ID NO: 313
  Description of Artificial Sequence: Synthetic polypeptide

SEQ ID NO: 324 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 325 - protein, 36 aa, Artificial Sequence; identical to SEQ ID NO: 317
  Description of Artificial Sequence: Synthetic polypeptide

SEQ ID NO: 326 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 327 - protein, 36 aa, Artificial Sequence; identical to SEQ ID NO: 313
  Description of Artificial Sequence: Synthetic polypeptide

SEQ ID NO: 328 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 329 - protein, 36 aa, Artificial Sequence
  Description of Artificial Sequence: Synthetic polypeptide
GSTSSTAESPGPGSTSESPSGTAPGSTSSTAESPGP

SEQ ID NO: 330 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 331 - protein, 36 aa, Artificial Sequence
  Description of Artificial Sequence: Synthetic polypeptide
GSTSSTAESPGPGSTSSTAESPGPGSTSSTAESPGP

SEQ ID NO: 332 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 333 - protein, 36 aa, Artificial Sequence
  Description of Artificial Sequence: Synthetic polypeptide
GSTSESPSGTAPGSTSSTAESPGPGSTSSTAESPGP

SEQ ID NO: 334 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 335 - protein, 36 aa, Artificial Sequence
  Description of Artificial Sequence: Synthetic polypeptide
GSTSESPSGTAPGSTSESPSGTAPGSTSESPSGTAP

SEQ ID NO: 336 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 337 - protein, 36 aa, Artificial Sequence; identical to SEQ ID NO: 331
  Description of Artificial Sequence: Synthetic polypeptide

SEQ ID NO: 338 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 339 - protein, 36 aa, Artificial Sequence; identical to SEQ ID NO: 313
  Description of Artificial Sequence: Synthetic polypeptide

SEQ ID NO: 340 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 341 - protein, 36 aa, Artificial Sequence
  Description of Artificial Sequence: Synthetic polypeptide
GSSPSASTGTGPGSSTPSGATGSPGSSTPSGATGSP

SEQ ID NO: 342 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 343 - protein, 36 aa, Artificial Sequence
  Description of Artificial Sequence: Synthetic polypeptide
GTSPSGESSTAPGTSTPESGSASPGSTSSTAESPGP

SEQ ID NO: 344 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 345 - protein, 36 aa, Artificial Sequence
  Description of Artificial Sequence: Synthetic polypeptide
GSTSSTAESPGPGSTSSTAESPGPGTSTPESGSASP

SEQ ID NO: 346 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 347 - protein, 36 aa, Artificial Sequence
  Description of Artificial Sequence: Synthetic polypeptide
GTSPSGESSTAPGSTSSTAESPGPGTSTPESGSASP

SEQ ID NO: 348 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 349 - protein, 36 aa, Artificial Sequence; identical to SEQ ID NO: 333
  Description of Artificial Sequence: Synthetic polypeptide

SEQ ID NO: 350 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 351 - protein, 36 aa, Artificial Sequence; identical to SEQ ID NO: 329
  Description of Artificial Sequence: Synthetic polypeptide

SEQ ID NO: 352 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 353 - protein, 36 aa, Artificial Sequence; identical to SEQ ID NO: 311
  Description of Artificial Sequence: Synthetic polypeptide

SEQ ID NO: 354 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 355 - protein, 36 aa, Artificial Sequence
  Description of Artificial Sequence: Synthetic polypeptide
GSTSESPSGTAPGSTSESPSGTAPGTSPSGESSTAP

SEQ ID NO: 356 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 357 - protein, 36 aa, Artificial Sequence
  Description of Artificial Sequence: Synthetic polypeptide
GSTSESPSGTAPGSTSESPSGTAPGTSTPESGSASP

SEQ ID NO: 358 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 359 - protein, 36 aa, Artificial Sequence
  Description of Artificial Sequence: Synthetic polypeptide
GTSTPESGSASPGSTSSTAESPGPGSTSSTAESPGP

SEQ ID NO: 360 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 361 - protein, 36 aa, Artificial Sequence; identical to SEQ ID NO: 355
  Description of Artificial Sequence: Synthetic polypeptide

SEQ ID NO: 362 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 363 - protein, 36 aa, Artificial Sequence
  Description of Artificial Sequence: Synthetic polypeptide
GSTSSTAESPGPGSTSSTAESPGPGSTSESPSGTAP

SEQ ID NO: 364 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 365 - protein, 36 aa, Artificial Sequence; identical to SEQ ID NO: 345
  Description of Artificial Sequence: Synthetic polypeptide

SEQ ID NO: 366 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 367 - protein, 36 aa, Artificial Sequence; identical to SEQ ID NO: 363
  Description of Artificial Sequence: Synthetic polypeptide

SEQ ID NO: 368 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 369 - protein, 36 aa, Artificial Sequence
  Description of Artificial Sequence: Synthetic polypeptide
GTSPSGESSTAPGSTSESPSGTAPGSTSSTAESPGP

SEQ ID NO: 370 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 371 - protein, 36 aa, Artificial Sequence
  Description of Artificial Sequence: Synthetic polypeptide
GSTSESPSGTAPGTSPSGESSTAPGSTSSTAESPGP

SEQ ID NO: 372 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 373 - protein, 36 aa, Artificial Sequence
  Description of Artificial Sequence: Synthetic polypeptide
GSTSSTAESPGPGSTSESPSGTAPGTSPSGESSTAP

SEQ ID NO: 374 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 375 - protein, 36 aa, Artificial Sequence; identical to SEQ ID NO: 357
  Description of Artificial Sequence: Synthetic polypeptide

SEQ ID NO: 376 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 377 - protein, 36 aa, Artificial Sequence
  Description of Artificial Sequence: Synthetic polypeptide
GTSTPESGSASPGSTSESPSGTAPGSTSSTAESPGP

SEQ ID NO: 378 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 379 - protein, 36 aa, Artificial Sequence
  Description of Artificial Sequence: Synthetic polypeptide
GSTSSTAESPGPGTSPSGESSTAPGTSPSGESSTAP

SEQ ID NO: 380 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 381 - protein, 36 aa, Artificial Sequence
  Description of Artificial Sequence: Synthetic polypeptide
GTSPSGESSTAPGTSPSGESSTAPGTSPSGESSTAP

SEQ ID NO: 382 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 383 - protein, 36 aa, Artificial Sequence; identical to SEQ ID NO: 317
  Description of Artificial Sequence: Synthetic polypeptide

SEQ ID NO: 384 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 385 - protein, 36 aa, Artificial Sequence
  Description of Artificial Sequence: Synthetic polypeptide
GSTSESPSGTAPGTSPSGESSTAPGTSPSGESSTAP

SEQ ID NO: 386 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 387 - protein, 36 aa, Artificial Sequence
  Description of Artificial Sequence: Synthetic polypeptide
GSTSESPSGTAPGTSTPESGSASPGSTSSTAESPGP

SEQ ID NO: 388 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 389 - protein, 36 aa, Artificial Sequence; identical to SEQ ID NO: 363
  Description of Artificial Sequence: Synthetic polypeptide

SEQ ID NO: 390 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 391 - protein, 36 aa, Artificial Sequence
  Description of Artificial Sequence: Synthetic polypeptide
GSTSESPSGTAPGTSTPESGSASPGTSTPESGSASP

SEQ ID NO: 392 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 393 - protein, 36 aa, Artificial Sequence; identical to SEQ ID NO: 391
  Description of Artificial Sequence: Synthetic polypeptide

SEQ ID NO: 394 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 395 - DNA, 36 bp, Artificial Sequence
  Description of Artificial Sequence: Synthetic oligonucleotide
aggtacycckggyagcggtacygcwtcttcytctcc

SEQ ID NO: 396 - DNA, 36 bp, Artificial Sequence
  Description of Artificial Sequence: Synthetic oligonucleotide
acctggagargaagawgcrgtaccgctrccmggrgt

SEQ ID NO: 397 - DNA, 36 bp, Artificial Sequence
  Description of Artificial Sequence: Synthetic oligonucleotide
aggtagctctacyccktctggtgcwacyggytcycc

SEQ ID NO: 398 - DNA, 36 bp, Artificial Sequence
  Description of Artificial Sequence: Synthetic oligonucleotide
acctggrgarccrgtwgcaccagamggrgtagagct

SEQ ID NO: 399 - DNA, 36 bp, Artificial Sequence
  Description of Artificial Sequence: Synthetic oligonucleotide
aggttctagcccktctgcwtcyacyggtacyggycc

SEQ ID NO: 400 - DNA, 36 bp, Artificial Sequence
  Description of Artificial Sequence: Synthetic oligonucleotide
acctggrccrgtaccrgtrgawgcagamgggctaga

SEQ ID NO: 401 - DNA, 36 bp, Artificial Sequence
  Description of Artificial Sequence: Synthetic oligonucleotide
aggtgcwtcycckggyacyagctctacyggttctcc

SEQ ID NO: 402 - DNA, 36 bp, Artificial Sequence
  Description of Artificial Sequence: Synthetic oligonucleotide
acctggagaaccrgtagagctrgtrccmggrgawgc

SEQ ID NO: 403 - protein, 36 aa, Artificial Sequence
  Description of Artificial Sequence: Synthetic polypeptide
GASPGTSSTGSPGTPGSGTASSSPGSSTPSGATGSP

SEQ ID NO: 404 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 405 - protein, 36 aa, Artificial Sequence
  Description of Artificial Sequence: Synthetic polypeptide
GSSTPSGATGSPGSSPSASTGTGPGSSTPSGATGSP

SEQ ID NO: 406 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 407 - protein, 36 aa, Artificial Sequence
  Description of Artificial Sequence: Synthetic polypeptide
GASPGTSSTGSPGSSPSASTGTGPGSSTPSGATGSP

SEQ ID NO: 408 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 409 - protein, 36 aa, Artificial Sequence
  Description of Artificial Sequence: Synthetic polypeptide
GTPGSGTASSSPGSSTPSGATGSPGASPGTSSTGSP

SEQ ID NO: 410 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 411 - protein, 36 aa, Artificial Sequence
  Description of Artificial Sequence: Synthetic polypeptide
GTPGSGTASSSPGASPGTSSTGSPGSRPSASTGTGP

SEQ ID NO: 412 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 413 - protein, 36 aa, Artificial Sequence
  Description of Artificial Sequence: Synthetic polypeptide
GASPGTSSTGSPGSSTPSGATGSPGASPGTSSTGSP

SEQ ID NO: 414 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 415 - protein, 36 aa, Artificial Sequence
  Description of Artificial Sequence: Synthetic polypeptide
GTPGSGTASSSPGSSTPSGATGSPGSSTPSGATGSP

SEQ ID NO: 416 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 417 - protein, 36 aa, Artificial Sequence
  Description of Artificial Sequence: Synthetic polypeptide
GASPGTSSTGSPGASPGTSSTGSPGASPGTSSTGSP

SEQ ID NO: 418 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 419 - protein, 36 aa, Artificial Sequence
  Description of Artificial Sequence: Synthetic polypeptide
GSSTPSGATGSPGSSPSASTGTGPGASPGTSSTGSP

SEQ ID NO: 420 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 421 - protein, 36 aa, Artificial Sequence
  Description of Artificial Sequence: Synthetic polypeptide
GSSTPSGATGSPGSSTPSGATGSPGTPGSGTASSSP

SEQ ID NO: 422 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 423 - protein, 36 aa, Artificial Sequence
  Description of Artificial Sequence: Synthetic polypeptide
GSSTPSGATGSPGSSTPSGATGSPGASPGTSSTGSP

SEQ ID NO: 424 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 425 - protein, 36 aa, Artificial Sequence
  Description of Artificial Sequence: Synthetic polypeptide
GTPGSGTASSSPGSSPSASTGTGPGSSTPSGATGSP

SEQ ID NO: 426 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 427 - protein, 36 aa, Artificial Sequence
  Description of Artificial Sequence: Synthetic polypeptide
GASPGTSSTGSPGSSPSASTGTGPGTPGSGTASSSP

SEQ ID NO: 428 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 429 - protein, 36 aa, Artificial Sequence; identical to SEQ ID NO: 423
  Description of Artificial Sequence: Synthetic polypeptide

SEQ ID NO: 430 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 431 - protein, 36 aa, Artificial Sequence
  Description of Artificial Sequence: Synthetic polypeptide
GTPGSGTASSSPGSSTPSGATGSPGSSPSASTGTGP

SEQ ID NO: 432 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 433 - protein, 36 aa, Artificial Sequence
  Description of Artificial Sequence: Synthetic polypeptide
GSSTPSGATGSPGTPGSGTASSSPGTPGSGTASSSP

SEQ ID NO: 434 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 435 - protein, 36 aa, Artificial Sequence; identical to SEQ ID NO: 409
  Description of Artificial Sequence: Synthetic polypeptide

SEQ ID NO: 436 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 437 - protein, 36 aa, Artificial Sequence; identical to SEQ ID NO: 423
  Description of Artificial Sequence: Synthetic polypeptide

SEQ ID NO: 438 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 439 - protein, 36 aa, Artificial Sequence; identical to SEQ ID NO: 403
  Description of Artificial Sequence: Synthetic polypeptide

SEQ ID NO: 440 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 441 - protein, 36 aa, Artificial Sequence
  Description of Artificial Sequence: Synthetic polypeptide
GSSPSASTGTGPGSSTPSGATGSPGTPGSGTASSSP

SEQ ID NO: 442 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 443 - protein, 36 aa, Artificial Sequence; identical to SEQ ID NO: 407
  Description of Artificial Sequence: Synthetic polypeptide

SEQ ID NO: 444 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 445 - protein, 36 aa, Artificial Sequence
  Description of Artificial Sequence: Synthetic polypeptide
GASPGTSSTGSPGSSTPSGATGSPGSSTPSGATGSP

SEQ ID NO: 446 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 447 - protein, 36 aa, Artificial Sequence
  Description of Artificial Sequence: Synthetic polypeptide
GTPGSGTASSSPGSSTPSGATGSPGTPGSGTASSSP

SEQ ID NO: 448 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 449 - protein, 36 aa, Artificial Sequence; identical to SEQ ID NO: 341
  Description of Artificial Sequence: Synthetic polypeptide

SEQ ID NO: 450 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 451 - protein, 36 aa, Artificial Sequence
  Description of Artificial Sequence: Synthetic polypeptide
GASPGTSSTGSPGSSPSASTGTGPGSSPSASTGTGP

SEQ ID NO: 452 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 453 - protein, 36 aa, Artificial Sequence
  Description of Artificial Sequence: Synthetic polypeptide
GTPGSGTASSSPGASPGTSSTGSPGASPGTSSTGSP

SEQ ID NO: 454 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 455 - protein, 36 aa, Artificial Sequence
  Description of Artificial Sequence: Synthetic polypeptide
GSSTPSGATGSPGASPGTSSTGSPGSSTPSGATGSP

SEQ ID NO: 456 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 457 - protein, 36 aa, Artificial Sequence
  Description of Artificial Sequence: Synthetic polypeptide
GSSTPSGATGSPGTPGSGTASSSPGSSTPSGATGSP

SEQ ID NO: 458 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 459 - protein, 36 aa, Artificial Sequence; identical to SEQ ID NO: 407
  Description of Artificial Sequence: Synthetic polypeptide

SEQ ID NO: 460 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 461 - protein, 36 aa, Artificial Sequence
  Description of Artificial Sequence: Synthetic polypeptide
GSSTPSGATGSPGSSTPSGATGSPGSSTPSGATGSP

SEQ ID NO: 462 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 463 - protein, 36 aa, Artificial Sequence
  Description of Artificial Sequence: Synthetic polypeptide
GASPGTSSTGSPGTPGSGTASSSPGASPGTSSTGSP

SEQ ID NO: 464 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 465 - protein, 36 aa, Artificial Sequence; identical to SEQ ID NO: 419
  Description of Artificial Sequence: Synthetic polypeptide

SEQ ID NO: 466 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 467 - protein, 36 aa, Artificial Sequence
  Description of Artificial Sequence: Synthetic polypeptide
GASPGTSSTGSPGSSTPSGATGSPGSSPSASTGTGP

SEQ ID NO: 468 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 469 - protein, 36 aa, Artificial Sequence; identical to SEQ ID NO: 409
  Description of Artificial Sequence: Synthetic polypeptide

SEQ ID NO: 470 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 471 - protein, 36 aa, Artificial Sequence; identical to SEQ ID NO: 457
  Description of Artificial Sequence: Synthetic polypeptide

SEQ ID NO: 472 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 473 - protein, 36 aa, Artificial Sequence
  Description of Artificial Sequence: Synthetic polypeptide
GSSPSASTGTGPGSSPSASTGTGPGASPGTSSTGSP

SEQ ID NO: 474 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 475 - protein, 36 aa, Artificial Sequence
  Description of Artificial Sequence: Synthetic polypeptide
GTPGSGTASSSPGSSTPSGATGSPGSNPSASTGTGP

SEQ ID NO: 476 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 477 - protein, 36 aa, Artificial Sequence
  Description of Artificial Sequence: Synthetic polypeptide
GSSPSASTGTGPGSSTPSGATGSPGASPGTSSTGSP

SEQ ID NO: 478 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 479 - protein, 36 aa, Artificial Sequence
  Description of Artificial Sequence: Synthetic polypeptide
GSSTPSGATGSPGASPGTSSTGSPGTPGSGTASSSP

SEQ ID NO: 480 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 481 - protein, 36 aa, Artificial Sequence; identical to SEQ ID NO: 461
  Description of Artificial Sequence: Synthetic polypeptide

SEQ ID NO: 482 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 483 - protein, 36 aa, Artificial Sequence; identical to SEQ ID NO: 403
  Description of Artificial Sequence: Synthetic polypeptide

SEQ ID NO: 484 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 485 - protein, 36 aa, Artificial Sequence
  Description of Artificial Sequence: Synthetic polypeptide
GSSTPSGATGSPGSSPSASTGTGPGSSPSASTGTGP

SEQ ID NO: 486 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 487 - protein, 36 aa, Artificial Sequence; identical to SEQ ID NO: 451
  Description of Artificial Sequence: Synthetic polypeptide

SEQ ID NO: 488 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 489 - protein, 36 aa, Artificial Sequence; identical to SEQ ID NO: 427
  Description of Artificial Sequence: Synthetic polypeptide

SEQ ID NO: 490 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 491 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 492 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 493 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 494 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 495 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 496 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 497 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 498 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 499 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 500 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 501 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 502 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 503 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 504 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 505 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 506 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 507 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 508 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 509 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 510 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 511 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 512 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 513 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 514 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 515 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 516 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 517 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 518 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 519 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 520 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 521 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 522 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 523 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 524 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 525 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 526 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 527 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 528 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 529 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 530 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 531 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 532 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 533 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 534 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 535 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 536 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 537 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 538 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 539 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 540 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 541 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 542 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 543 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 544 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 545 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 546 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 547 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 548 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 549 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 550 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 551 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 552 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 553 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 554 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 555 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 556 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 557 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 558 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 559 - protein, 11 aa, Artificial Sequence
  Description of Artificial Sequence: Synthetic peptide
GASASGAPSTG

SEQ ID NO: 560 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 561 - DNA, 49 bp, Artificial Sequence
  Description of Artificial Sequence: Synthetic oligonucleotide
cctcgagtgaagacgaacctccgcttggggccggccccgttggttctgg

SEQ ID NO: 562 - protein, 11 aa, Artificial Sequence
  Description of Artificial Sequence: Synthetic peptide
GPEPTGPAPSG

SEQ ID NO: 563 - protein, 13 aa, Artificial Sequence
  Description of Artificial Sequence: Synthetic peptide
MASPAGSPTSTEE

SEQ ID NO: 564 - protein, 13 aa, Artificial Sequence
  Description of Artificial Sequence: Synthetic peptide
MATSESATPESGP

SEQ ID NO: 565 - protein, 13 aa, Artificial Sequence
  Description of Artificial Sequence: Synthetic peptide
MATSPSGESSTAP

SEQ ID NO: 566 - protein, 13 aa, Artificial Sequence
  Description of Artificial Sequence: Synthetic peptide
MESTSSTAESPGP

SEQ ID NO: 567 - protein, 13 aa, Artificial Sequence
  Description of Artificial Sequence: Synthetic peptide
MASSTPSGATGSP

SEQ ID NO: 568 - protein, 13 aa, Artificial Sequence
  Description of Artificial Sequence: Synthetic peptide
MEASPGTSSTGSP

SEQ ID NO: 569 - protein, 11 aa, Artificial Sequence
  Description of Artificial Sequence: Synthetic peptide
MASTPESGSSG

SEQ ID NO: 570 - DNA, 51 bp, Artificial Sequence
  Description of Artificial Sequence: Synthetic oligonucleotide
atggctagtccggctggctctccgacctccactgaggaaggtacttctact

SEQ ID NO: 571 - DNA, 51 bp, Artificial Sequence
  Description of Artificial Sequence: Synthetic oligonucleotide
atggctagtcctgctggctctccaacctccactgaggaaggtacttctact

SEQ ID NO: 572 - DNA, 51 bp, Artificial Sequence
  Description of Artificial Sequence: Synthetic oligonucleotide
atggctagtccagcaggctctcctacctccaccgaggaaggtacttctact

SEQ ID NO: 573 - DNA, 51 bp, Artificial Sequence
  Description of Artificial Sequence: Synthetic oligonucleotide
atggctagtcctgctggctctccgacctctactgaggaaggtacttctact

SEQ ID NO: 574 - DNA, 51 bp, Artificial Sequence
  Description of Artificial Sequence: Synthetic oligonucleotide
atggctacatccgaaagcgcaacccctgagtccggtccaggtacttctact

SEQ ID NO: 575 - DNA, 51 bp, Artificial Sequence
  Description of Artificial Sequence: Synthetic oligonucleotide
atggctacatccgaaagcgcaacccctgaatctggtccaggtacttctact

SEQ ID NO: 576 - DNA, 51 bp, Artificial Sequence
  Description of Artificial Sequence: Synthetic oligonucleotide
atggctacgtctgaaagcgctactccggaatctggtccaggtacttctact

SEQ ID NO: 577 - DNA, 51 bp, Artificial Sequence
  Description of Artificial Sequence: Synthetic oligonucleotide
atggctacgtccgaaagcgctacccctgaatccggtccaggtacttctact

SEQ ID NO: 578 - DNA, 51 bp, Artificial Sequence
  Description of Artificial Sequence: Synthetic oligonucleotide
atggctagttctaccccgtctggtgcaaccggttccccaggtacttctact

SEQ ID NO: 579 - DNA, 51 bp, Artificial Sequence
  Description of Artificial Sequence: Synthetic oligonucleotide
atggctagctccactccgtctggtgctaccggttccccaggtacttctact

SEQ ID NO: 580 - DNA, 51 bp, Artificial Sequence
  Description of Artificial Sequence: Synthetic oligonucleotide
atggctagctctactccgtctggtgctactggttccccaggtacttctact

SEQ ID NO: 581 - DNA, 51 bp, Artificial Sequence
  Description of Artificial Sequence: Synthetic oligonucleotide
atggctagttctaccccttctggtgctactggttctccaggtacttctact

SEQ ID NO: 582 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 583 - DNA, 180 bp, Artificial Sequence; identical to SEQ ID NO: 582
  Description of Artificial Sequence: Synthetic polynucleotide

SEQ ID NO: 584 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 585 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 586 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 587 - DNA, 180 bp, Artificial Sequence; identical to SEQ ID NO: 585
  Description of Artificial Sequence: Synthetic polynucleotide

SEQ ID NO: 588 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 589 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 590 - DNA, 180 bp, Artificial Sequence; identical to SEQ ID NO: 588
  Description of Artificial Sequence: Synthetic polynucleotide

SEQ ID NO: 591 - DNA, 180 bp, Artificial Sequence; identical to SEQ ID NO: 589
  Description of Artificial Sequence: Synthetic polynucleotide

SEQ ID NO: 592 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 593 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 594 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 595 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 596 - protein, 1328 aa, Artificial Sequence
  Description of Artificial Sequence: Synthetic polypeptide
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSENLYFQGGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 597 - DNA, 3987 bp, Artificial Sequence
  Description of Artificial Sequence: Synthetic polynucleotide
atggtctcccaggccctcaggctcctctgccttctgcttgggcttcagggctgcctggctgcagtgttcgtaacccaggaggaagcccacggcgtcctgcaccggcgccggcgcgccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggcccagaaggcccatccgaaaatctgtattttcagggtgggtctccaggttctccagccgggtccccaacttcgaccgaggaagggacctccgagtcagctaccccggagtccggtcctggcacctccaccgaaccatcggagggcagcgcccctgggagccctgccgggagccctacaagcaccgaagagggcaccagtacagagccaagtgaggggagcgcccctggtactagtactgaaccatccgaggggtcagctccaggcacgagtgagtccgctacccccgagagcggaccgggctcagagcccgccacgagtggcagtgaaactccaggctcagaacccgccactagtgggtcagagactccaggcagccctgccggatcccctacgtccaccgaggagggaacatctgagtccgcaacacccgaatccggtccaggcacctccacggaacctagtgaaggctcggcaccaggtacaagcaccgaacctagcgagggcagcgctcccggcagccctgccggcagcccaacctcaactgaggagggcaccagtactgagcccagcgagggatcagcacctggcaccagcaccgaacctagcgaggggagcgcccctgggactagcgagtcagctacaccagagagcgggcctggaacttctaccgaacccagtgagggatccgctccaggcacctccgaatccgcaacccccgaatccggacctggctcagagcccgccaccagcgggagcgaaacccctggcacatccaccgagcctagcgaagggtccgcacccggcaccagtacagagcctagcgagggatcagcacctggcaccagtgaatctgctacaccagagagcggccctggaacctccgagtccgctacccccgagagcgggccaggttctcctgctggctcccccacctcaacagaagaggggacaagcgaaagcgctacgcctgagagtggccctggctctgagccagccacctccggctctgaaacccctggcactagtgagtctgccacgcctgagtccggacccgggacctctactgagccctcggaggggagcgctcctggcacgagtacagaaccttccgaaggaagtgcaccgggcacaagcaccgagccttccgaaggctctgctcccggaacctctaccgaaccctctgaagggtctgcacccggcacgagcaccgaacccagcgaagggtcagcgcctgggacctcaacagagccctcggaaggatcagcgcctggaagccctgcagggagtccaacttccacggaagaaggaacgtctacagagccatcagaggggtccgcaccaggtaccagcgaatccgctactcccgaatctggccctgggtccgaacctgccacctccggctctgaaactccagggacctccgaatctgccacacccgagagcggccctggctccgagcccgcaacatctggcagcgagacacctggcacctccgagagcgcaacacccgagagcggccctggcaccagcaccgagccatccgagggatccgccccaggcacttctgagtcagccacacccgaaagcggaccaggatcacccgctggctcccccaccagtaccgaggaggggtcccccgctggaagtccaacaagcactgaggaagggtcccctgccggctcccccacaagtaccgaagagggcacaagtgagagcgccactcccgagtccgggcctggcaccagcacagagccttccgaggggtccgcaccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggttcgtcttcataa

SEQ ID NO: 598 - protein, 1315 aa, Artificial Sequence
  Description of Artificial Sequence: Synthetic polypeptide
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 599 - DNA, 3932 bp, Artificial Sequence
  Description of Artificial Sequence: Synthetic polynucleotide
atggtctcccaggccctcaggctcctctgccttctgcttgggcttcagggctgcctggctgcagtgttcgtaacccaggaggaagcccacggcgtcctgcaccggcgccggcgcgccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggacccgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 600 - protein, 739 aa, Artificial Sequence
  Description of Artificial Sequence: Synthetic polypeptide
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGSPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 601 - DNA, 2219 bp, Artificial Sequence
  Description of Artificial Sequence: Synthetic polynucleotide
atggtgtcccaggccctcaggctcctctgccttctgcttgggcttcagggctgcctggctgcagtgttcgtaacccaggaggaagcccacggcgtcctgcaccggcgccggcgcgccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtgtccgcggcccactgtttcgacaaaatcaagaactggagaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtgtcccagtacatcgagtggctgcaaaagctcatgcgctcagagccacgcccaggagtcctcctgcgagccccatttcccgggtctccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggttcgtcttcataa

SEQ ID NO: 602 - protein, 1338 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 603 - DNA, 4017 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggttaa

SEQ ID NO: 604 - protein, 1327 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 605 - DNA, 3984 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 606 - protein, 1338 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPGGGGASASGAPSTGGGGSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPG

SEQ ID NO: 607 - DNA, 4017 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggaggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccggggggggggggtgcaagcgcaagcggcgcgccaagcacgggaggggggggtagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggttaa

SEQ ID NO: 608 - protein, 1327 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPG

SEQ ID NO: 609 - DNA, 3984 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggaggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggttaa

SEQ ID NO: 610 - protein, 913 aa, Artificial Sequence
  Description of Artificial Sequence: Synthetic polypeptide
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 611 - DNA, 2742 bp, Artificial Sequence
  Description of Artificial Sequence: Synthetic polynucleotide
atgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatgcaacggaagagtcctgggcggaaggaggcttctgtatgcttgtgaaaaagaacaatctgtgccaacggaaggttcttcaacaactttgctgcaaaacatgtacatttcaaggctga

SEQ ID NO: 612 - protein, 1345 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGPEGPSENLYFQGGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 613 - DNA, 4038 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtgttccacaaagggagatcagctttagttcttcagtaccttagagttccacttgttgaccgagccacatgtctacgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggcccagaaggcccatccgaaaatctgtattttcagggtgggtctccaggttctccagccgggtccccaacttcgaccgaggaagggacctccgagtcagctaccccggagtccggtcctggcacctccaccgaaccatcggagggcagcgcccctgggagccctgccgggagccctacaagcaccgaagagggcaccagtacagagccaagtgaggggagcgcccctggtactagtactgaaccatccgaggggtcagctccaggcacgagtgagtccgctacccccgagagcggaccgggctcagagcccgccacgagtggcagtgaaactccaggctcagaacccgccactagtgggtcagagactccaggcagccctgccggatcccctacgtccaccgaggagggaacatctgagtccgcaacacccgaatccggtccaggcacctccacggaacctagtgaaggctcggcaccaggtacaagcaccgaacctagcgagggcagcgctcccggcagccctgccggcagcccaacctcaactgaggagggcaccagtactgagcccagcgagggatcagcacctggcaccagcaccgaacctagcgaggggagcgcccctgggactagcgagtcagctacaccagagagcgggcctggaacttctaccgaacccagtgagggatccgctccaggcacctccgaatccgcaacccccgaatccggacctggctcagagcccgccaccagcgggagcgaaacccctggcacatccaccgagcctagcgaagggtccgcacccggcaccagtacagagcctagcgagggatcagcacctggcaccagtgaatctgctacaccagagagcggccctggaacctccgagtccgctacccccgagagcgggccaggttctcctgctggctcccccacctcaacagaagaggggacaagcgaaagcgctacgcctgagagtggccctggctctgagccagccacctccggctctgaaacccctggcactagtgagtctgccacgcctgagtccggacccgggacctctactgagccctcggaggggagcgctcctggcacgagtacagaaccttccgaaggaagtgcaccgggcacaagcaccgagccttccgaaggctctgctcccggaacctctaccgaaccctctgaagggtctgcacccggcacgagcaccgaacccagcgaagggtcagcgcctgggacctcaacagagccctcggaaggatcagcgcctggaagccctgcagggagtccaacttccacggaagaaggaacgtctacagagccatcagaggggtccgcaccaggtaccagcgaatccgctactcccgaatctggccctgggtccgaacctgccacctccggctctgaaactccagggacctccgaatctgccacacccgagagcggccctggctccgagcccgcaacatctggcagcgagacacctggcacctccgagagcgcaacacccgagagcggccctggcaccagcaccgagccatccgagggatccgccccaggcacttctgagtcagccacacccgaaagcggaccaggatcacccgctggctcccccaccagtaccgaggaggggtcccccgctggaagtccaacaagcactgaggaagggtcccctgccggctcccccacaagtaccgaagagggcacaagtgagagcgccactcccgagtccgggcctggcaccagcacagagccttccgaggggtccgcaccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggttcgtcttcataa

SEQ ID NO: 614 - protein, 1345 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 615 - DNA, 4038 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtgttccacaaagggagatcagctttagttcttcagtaccttagagttccacttgttgaccgagccacatgtctacgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggcccagaaggcccatccaagctaacgcgtgcggagacagggtctccaggttctccagccgggtccccaacttcgaccgaggaagggacctccgagtcagctaccccggagtccggtcctggcacctccaccgaaccatcggagggcagcgcccctgggagccctgccgggagccctacaagcaccgaagagggcaccagtacagagccaagtgaggggagcgcccctggtactagtactgaaccatccgaggggtcagctccaggcacgagtgagtccgctacccccgagagcggaccgggctcagagcccgccacgagtggcagtgaaactccaggctcagaacccgccactagtgggtcagagactccaggcagccctgccggatcccctacgtccaccgaggagggaacatctgagtccgcaacacccgaatccggtccaggcacctccacggaacctagtgaaggctcggcaccaggtacaagcaccgaacctagcgagggcagcgctcccggcagccctgccggcagcccaacctcaactgaggagggcaccagtactgagcccagcgagggatcagcacctggcaccagcaccgaacctagcgaggggagcgcccctgggactagcgagtcagctacaccagagagcgggcctggaacttctaccgaacccagtgagggatccgctccaggcacctccgaatccgcaacccccgaatccggacctggctcagagcccgccaccagcgggagcgaaacccctggcacatccaccgagcctagcgaagggtccgcacccggcaccagtacagagcctagcgagggatcagcacctggcaccagtgaatctgctacaccagagagcggccctggaacctccgagtccgctacccccgagagcgggccaggttctcctgctggctcccccacctcaacagaagaggggacaagcgaaagcgctacgcctgagagtggccctggctctgagccagccacctccggctctgaaacccctggcactagtgagtctgccacgcctgagtccggacccgggacctctactgagccctcggaggggagcgctcctggcacgagtacagaaccttccgaaggaagtgcaccgggcacaagcaccgagccttccgaaggctctgctcccggaacctctaccgaaccctctgaagggtctgcacccggcacgagcaccgaacccagcgaagggtcagcgcctgggacctcaacagagccctcggaaggatcagcgcctggaagccctgcagggagtccaacttccacggaagaaggaacgtctacagagccatcagaggggtccgcaccaggtaccagcgaatccgctactcccgaatctggccctgggtccgaacctgccacctccggctctgaaactccagggacctccgaatctgccacacccgagagcggccctggctccgagcccgcaacatctggcagcgagacacctggcacctccgagagcgcaacacccgagagcggccctggcaccagcaccgagccatccgagggatccgccccaggcacttctgagtcagccacacccgaaagcggaccaggatcacccgctggctcccccaccagtaccgaggaggggtcccccgctggaagtccaacaagcactgaggaagggtcccctgccggctcccccacaagtaccgaagagggcacaagtgagagcgccactcccgagtccgggcctggcaccagcacagagccttccgaggggtccgcaccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggttcgtcttcataa

SEQ ID NO: 616 - protein, 1345 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGPEGPSDFTRVVGGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 617 - DNA, 4038 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtgttccacaaagggagatcagctttagttcttcagtaccttagagttccacttgttgaccgagccacatgtctacgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggcccagaaggcccatccgacttcacacgggtagttggcgggtctccaggttctccagccgggtccccaacttcgaccgaggaagggacctccgagtcagctaccccggagtccggtcctggcacctccaccgaaccatcggagggcagcgcccctgggagccctgccgggagccctacaagcaccgaagagggcaccagtacagagccaagtgaggggagcgcccctggtactagtactgaaccatccgaggggtcagctccaggcacgagtgagtccgctacccccgagagcggaccgggctcagagcccgccacgagtggcagtgaaactccaggctcagaacccgccactagtgggtcagagactccaggcagccctgccggatcccctacgtccaccgaggagggaacatctgagtccgcaacacccgaatccggtccaggcacctccacggaacctagtgaaggctcggcaccaggtacaagcaccgaacctagcgagggcagcgctcccggcagccctgccggcagcccaacctcaactgaggagggcaccagtactgagcccagcgagggatcagcacctggcaccagcaccgaacctagcgaggggagcgcccctgggactagcgagtcagctacaccagagagcgggcctggaacttctaccgaacccagtgagggatccgctccaggcacctccgaatccgcaacccccgaatccggacctggctcagagcccgccaccagcgggagcgaaacccctggcacatccaccgagcctagcgaagggtccgcacccggcaccagtacagagcctagcgagggatcagcacctggcaccagtgaatctgctacaccagagagcggccctggaacctccgagtccgctacccccgagagcgggccaggttctcctgctggctcccccacctcaacagaagaggggacaagcgaaagcgctacgcctgagagtggccctggctctgagccagccacctccggctctgaaacccctggcactagtgagtctgccacgcctgagtccggacccgggacctctactgagccctcggaggggagcgctcctggcacgagtacagaaccttccgaaggaagtgcaccgggcacaagcaccgagccttccgaaggctctgctcccggaacctctaccgaaccctctgaagggtctgcacccggcacgagcaccgaacccagcgaagggtcagcgcctgggacctcaacagagccctcggaaggatcagcgcctggaagccctgcagggagtccaacttccacggaagaaggaacgtctacagagccatcagaggggtccgcaccaggtaccagcgaatccgctactcccgaatctggccctgggtccgaacctgccacctccggctctgaaactccagggacctccgaatctgccacacccgagagcggccctggctccgagcccgcaacatctggcagcgagacacctggcacctccgagagcgcaacacccgagagcggccctggcaccagcaccgagccatccgagggatccgccccaggcacttctgagtcagccacacccgaaagcggaccaggatcacccgctggctcccccaccagtaccgaggaggggtcccccgctggaagtccaacaagcactgaggaagggtcccctgccggctcccccacaagtaccgaagagggcacaagtgagagcgccactcccgagtccgggcctggcaccagcacagagccttccgaggggtccgcaccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggttcgtcttcataa

SEQ ID NO: 618 - protein, 1345 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGPEQTSKLTRAETVFPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 619 - DNA, 4038 bp, Artificial Sequence
  Description of Artificial Sequence: Synthetic polynucleotide
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtgttccacaaagggagatcagctttagttcttcagtaccttagagttccacttgttgaccgagccacatgtctacgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggcccagaacaaacatctaagctaacgcgtgcggagacagtatttccaggttctccagccgggtccccaacttcgaccgaggaagggacctccgagtcagctaccccggagtccggtcctggcacctccaccgaaccatcggagggcagcgcccctgggagccctgccgggagccctacaagcaccgaagagggcaccagtacagagccaagtgaggggagcgcccctggtactagtactgaaccatccgaggggtcagctccaggcacgagtgagtccgctacccccgagagcggaccgggctcagagcccgccacgagtggcagtgaaactccaggctcagaacccgccactagtgggtcagagactccaggcagccctgccggatcccctacgtccaccgaggagggaacatctgagtccgcaacacccgaatccggtccaggcacctccacggaacctagtgaaggctcggcaccaggtacaagcaccgaacctagcgagggcagcgctcccggcagccctgccggcagcccaacctcaactgaggagggcaccagtactgagcccagcgagggatcagcacctggcaccagcaccgaacctagcgaggggagcgcccctgggactagcgagtcagctacaccagagagcgggcctggaacttctaccgaacccagtgagggatccgctccaggcacctccgaatccgcaacccccgaatccggacctggctcagagcccgccaccagcgggagcgaaacccctggcacatccaccgagcctagcgaagggtccgcacccggcaccagtacagagcctagcgagggatcagcacctggcaccagtgaatctgctacaccagagagcggccctggaacctccgagtccgctacccccgagagcgggccaggttctcctgctggctcccccacctcaacagaagaggggacaagcgaaagcgctacgcctgagagtggccctggctctgagccagccacctccggctctgaaacccctggcactagtgagtctgccacgcctgagtccggacccgggacctctactgagccctcggaggggagcgctcctggcacgagtacagaaccttccgaaggaagtgcaccgggcacaagcaccgagccttccgaaggctctgctcccggaacctctaccgaaccctctgaagggtctgcacccggcacgagcaccgaacccagcgaagggtcagcgcctgggacctcaacagagccctcggaaggatcagcgcctggaagccctgcagggagtccaacttccacggaagaaggaacgtctacagagccatcagaggggtccgcaccaggtaccagcgaatccgctactcccgaatctggccctgggtccgaacctgccacctccggctctgaaactccagggacctccgaatctgccacacccgagagcggccctggctccgagcccgcaacatctggcagcgagacacctggcacctccgagagcgcaacacccgagagcggccctggcaccagcaccgagccatccgagggatccgccccaggcacttctgagtcagccacacccgaaagcggaccaggatcacccgctggctcccccaccagtaccgaggaggggtcccccgctggaagtccaacaagcactgaggaagggtcccctgccggctcccccacaagtaccgaagagggcacaagtgagagcgccactcccgagtccgggcctggcaccagcacagagccttccgaggggtccgcaccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggttcgtcttcataa

SEQ ID NO: 620 - protein, 8 aa, Artificial Sequence
  Description of Artificial Sequence: Synthetic peptide
SPFRVVGG

SEQ ID NO: 621 - protein, 6 aa, Artificial Sequence
  Description of Artificial Sequence: Synthetic peptide
KNSADK

SEQ ID NO: 622 - protein, 7 aa, Artificial Sequence
  Description of Artificial Sequence: Synthetic peptide
KNSADNK

SEQ ID NO: 623 - protein, 4 aa, Artificial Sequence
  Description of Artificial Sequence: Synthetic peptide
ADNK

SEQ ID NO: 624 - protein, 4 aa, Artificial Sequence
  Description of Artificial Sequence: Synthetic peptide
LAEN

SEQ ID NO: 625 - protein, 22 aa, Artificial Sequence
  Description of Artificial Sequence: Synthetic peptide
KLTRAETVFPDVDYVNSTEAET

SEQ ID NO: 626 - protein, 22 aa, Artificial Sequence
  Description of Artificial Sequence: Synthetic peptide
ILDNITQSTQSFNDFTRVVGGE

SEQ ID NO: 627 - protein, 9 aa, Artificial Sequence
  Description of Artificial Sequence: Synthetic peptide
FGFEGKNCE

SEQ ID NO: 628 - protein, 11 aa, Artificial Sequence
  Description of Artificial Sequence: Synthetic peptide
LDVTCNIKNGR

SEQ ID NO: 629 - protein, 12 aa, Artificial Sequence
  Description of Artificial Sequence: Synthetic peptide
GSTSESPSGTAP

SEQ ID NO: 630 - protein, 12 aa, Artificial Sequence
  Description of Artificial Sequence: Synthetic peptide
GTSTPESGSASP

SEQ ID NO: 631 - protein, 12 aa, Artificial Sequence
  Description of Artificial Sequence: Synthetic peptide
GTSPSGESSTAP

SEQ ID NO: 632 - protein, 12 aa, Artificial Sequence
  Description of Artificial Sequence: Synthetic peptide
GSTSSTAESPGP

SEQ ID NO: 633 - protein, 24 aa, Artificial Sequence
  Description of Artificial Sequence: Synthetic peptide
GSPAGSPTSTEEGTSESATPESGP

SEQ ID NO: 634 - protein, 36 aa, Artificial Sequence; identical to SEQ ID NO: 225
  Description of Artificial Sequence: Synthetic polypeptide

SEQ ID NO: 635 - protein, 48 aa, Artificial Sequence
  Description of Artificial Sequence: Synthetic polypeptide
GSPAGSPTSTEEGTSESATPESGPGTSTEPSEGSAPGSPAGSPTSTEE

SEQ ID NO: 636 - protein, 60 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAP

SEQ ID NO: 637 - protein, 108 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETP

SEQ ID NO: 638 - protein, 216 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP

SEQ ID NO: 639 - protein, 432 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAP

SEQ ID NO: 640 - protein, 864 aa, Artificial Sequence; identical to SEQ ID NO: 73
  Description of Artificial Sequence: Synthetic polypeptide

SEQ ID NO: 641 - protein, 576 aa, Artificial Sequence; identical to SEQ ID NO: 68
  Description of Artificial Sequence: Synthetic polypeptide

SEQ ID NO: 642 - protein, 576 aa, Artificial Sequence; identical to SEQ ID NO: 69
  Description of Artificial Sequence: Synthetic polypeptide

SEQ ID NO: 643 - protein, 540 aa, Artificial Sequence; identical to SEQ ID NO: 67
  Description of Artificial Sequence: Synthetic polypeptide

SEQ ID NO: 644 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 645 - protein, 864 aa, Artificial Sequence; identical to SEQ ID NO: 73
  Description of Artificial Sequence: Synthetic polypeptide

SEQ ID NO: 646 - protein, 875 aa, Artificial Sequence; identical to SEQ ID NO: 74
  Description of Artificial Sequence: Synthetic polypeptide
  MOD_RES (430)..(432): Any amino acid
  MOD_RES (443)..(446): Any amino acid

SEQ ID NO: 647 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 648 - protein, 875 aa, Artificial Sequence; identical to SEQ ID NO: 76
  Description of Artificial Sequence: Synthetic polypeptide

SEQ ID NO: 649 - protein, 1318 aa, Artificial Sequence; identical to SEQ ID NO: 79
  Description of Artificial Sequence: Synthetic polypeptide

SEQ ID NO: 650 - protein, 924 aa, Artificial Sequence; identical to SEQ ID NO: 78
  Description of Artificial Sequence: Synthetic polypeptide

SEQ ID NO: 651 - protein, 913 aa, Artificial Sequence; identical to SEQ ID NO: 77
  Description of Artificial Sequence: Synthetic polypeptide

SEQ ID NO: 652 - protein, 864 aa, Artificial Sequence; identical to SEQ ID NO: 80
  Description of Artificial Sequence: Synthetic polypeptide

SEQ ID NO: 653 - protein, 84 aa, Artificial Sequence
  Description of Artificial Sequence: Synthetic polypeptide
ASPAAPAPASPAAPAPSAPAAAPASPAPAAPSAPAPAAPSAASPAAPSAPPAAASPAAPSAPPAASAAAPAAASAAASAPSAAA

SEQ ID NO: 654 - protein, 4 aa, Artificial Sequence
  Description of Artificial Sequence: Synthetic peptide
GGSG

SEQ ID NO: 655 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 656 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 657 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 658 - protein, 288 aa, Artificial Sequence; identical to SEQ ID NO: 82
  Description of Artificial Sequence: Synthetic polypeptide

SEQ ID NO: 659 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 660 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 661 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 662 - protein, 576 aa, Artificial Sequence; identical to SEQ ID NO: 83
  Description of Artificial Sequence: Synthetic polypeptide

SEQ ID NO: 663 - protein, 576 aa, Artificial Sequence; identical to SEQ ID NO: 68
  Description of Artificial Sequence: Synthetic polypeptide

SEQ ID NO: 664 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 665 - protein, 540 aa, Artificial Sequence; identical to SEQ ID NO: 67
  Description of Artificial Sequence: Synthetic polypeptide

SEQ ID NO: 666 - protein, 504 aa, Artificial Sequence; identical to SEQ ID NO: 644
  Description of Artificial Sequence: Synthetic polypeptide

SEQ ID NO: 667 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 668 - protein, 875 aa, Artificial Sequence; identical to SEQ ID NO: 74
  Description of Artificial Sequence: Synthetic polypeptide
  MOD_RES (430)..(432): Any amino acid
  MOD_RES (443)..(446): Any amino acid

SEQ ID NO: 669 - protein, 868 aa, Artificial Sequence; identical to SEQ ID NO: 647
  Description of Artificial Sequence: Synthetic polypeptide

SEQ ID NO: 670 - protein, 875 aa, Artificial Sequence; identical to SEQ ID NO: 76
  Description of Artificial Sequence: Synthetic polypeptide

SEQ ID NO: 671 - protein, 1318 aa, Artificial Sequence; identical to SEQ ID NO: 79
  Description of Artificial Sequence: Synthetic polypeptide

SEQ ID NO: 672 - protein, 9 aa, Artificial Sequence
  Description of Artificial Sequence: Synthetic peptide
FDKLPRTSG

SEQ ID NO: 673 - protein, 7 aa, Artificial Sequence
  Description of Artificial Sequence: Synthetic peptide
FKLMVWY

SEQ ID NO: 674 - protein, 695 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 675 - DNA, 2085 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 676 - protein, 1271 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 677 - DNA, 3813 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 678 - protein, 1282 aa, Artificial Sequence
  Description of Artificial Sequence: Synthetic polypeptide
  MOD_RES (837)..(839): Any amino acid
  MOD_RES (850)..(853): Any amino acid
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 679 - DNA, 3846 bp, Artificial Sequence
  Description of Artificial Sequence: Synthetic polynucleotide
  modified_base (2508)..(2519): a, c, t, g, unknown or other
  modified_base (2551)..(2558): a, c, t, g, unknown or other
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 680 - protein, 1271 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 681 - DNA, 3813 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 682 - protein, 1282 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 683 - DNA, 3846 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 684 - protein, 1725 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 685 - DNA, 5175 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 686 - protein, 704 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 687 - DNA, 2114 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 688 - protein, 1280 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 689 - DNA, 3842 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 690 - protein, 1291 aa, Artificial Sequence
  Description of Artificial Sequence: Synthetic polypeptide
  MOD_RES (846)..(848): Any amino acid
  MOD_RES (859)..(862): Any amino acid
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 691 - DNA, 3875 bp, Artificial Sequence
  Description of Artificial Sequence: Synthetic polynucleotide
  modified_base (2537)..(2548): a, c, t, g, unknown or other
  modified_base (2580)..(2587): a, c, t, g, unknown or other
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 692 - protein, 1280 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 693 - DNA, 3842 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 694 - protein, 1291 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 695 - DNA, 3875 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 696 - protein, 1280 aa, Artificial Sequence; identical to SEQ ID NO: 692
  Description of Artificial Sequence: Synthetic polypeptide

SEQ ID NO: 697 - DNA, 3842 bp, Artificial Sequence; identical to SEQ ID NO: 693
  Description of Artificial Sequence: Synthetic polynucleotide

SEQ ID NO: 698 - protein, 1291 aa, Artificial Sequence; identical to SEQ ID NO: 694
  Description of Artificial Sequence: Synthetic polypeptide

SEQ ID NO: 699 - DNA, 3875 bp, Artificial Sequence; identical to SEQ ID NO: 695
  Description of Artificial Sequence: Synthetic polynucleotide

SEQ ID NO: 700 - protein, 1734 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 701 - DNA, 5204 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 702 - protein, 703 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGKLTRAETGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 703 - DNA, 2088 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 704 - protein, 1279 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGKLTRAETGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 705 - DNA, 3816 bp, Artificial Sequence
  Description of Artificial Sequence: Synthetic polynucleotide
gccaacgcgttcctggaggagctacggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttcccggtggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 706 - protein, 712 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGKLTRAETGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 707 - DNA, 2117 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 708 - protein, 1288 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGKLTRAETGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 709 - DNA, 3845 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 710 - protein, 704 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGTMTRIVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 711 - DNA, 2088 bp, Artificial Sequence; identical to SEQ ID NO: 703
  Description of Artificial Sequence: Synthetic polynucleotide

SEQ ID NO: 712 - protein, 1280 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGTMTRIVGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 713 - DNA, 3816 bp, Artificial Sequence; identical to SEQ ID NO: 705
  Description of Artificial Sequence: Synthetic polynucleotide

SEQ ID NO: 714 - protein, 713 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGTMTRIVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 715 - DNA, 2117 bp, Artificial Sequence; identical to SEQ ID NO: 707
  Description of Artificial Sequence: Synthetic polynucleotide

SEQ ID NO: 716 - protein, 1289 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGTMTRIVGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 717 - DNA, 3845 bp, Artificial Sequence; identical to SEQ ID NO: 709
  Description of Artificial Sequence: Synthetic polynucleotide

SEQ ID NO: 718 - protein, 704 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGSPFRSTGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 719 - DNA, 2088 bp, Artificial Sequence; identical to SEQ ID NO: 703
  Description of Artificial Sequence: Synthetic polynucleotide

SEQ ID NO: 720 - protein, 1280 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGSPFRSTGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 721 - DNA, 3816 bp, Artificial Sequence; identical to SEQ ID NO: 705
  Description of Artificial Sequence: Synthetic polynucleotide

SEQ ID NO: 722 - protein, 713 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGSPFRSTGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 723 - DNA, 2117 bp, Artificial Sequence; identical to SEQ ID NO: 707
  Description of Artificial Sequence: Synthetic polynucleotide

SEQ ID NO: 724 - protein, 1289 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGSPFRSTGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 725 - DNA, 3845 bp, Artificial Sequence; identical to SEQ ID NO: 709
  Description of Artificial Sequence: Synthetic polynucleotide

SEQ ID NO: 726 - protein, 704 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGLTPRSLLVGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 727 - DNA, 2088 bp, Artificial Sequence; identical to SEQ ID NO: 703
  Description of Artificial Sequence: Synthetic polynucleotide

SEQ ID NO: 728 - protein, 1280 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGLTPRSLLVGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 729 - DNA, 3816 bp, Artificial Sequence; identical to SEQ ID NO: 705
  Description of Artificial Sequence: Synthetic polynucleotide

SEQ ID NO: 730 - protein, 713 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGLTPRSLLVGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 731 - DNA, 2117 bp, Artificial Sequence; identical to SEQ ID NO: 707
  Description of Artificial Sequence: Synthetic polynucleotide

SEQ ID NO: 732 - protein, 1289 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGLTPRSLLVGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 733 - DNA, 3845 bp, Artificial Sequence; identical to SEQ ID NO: 709
  Description of Artificial Sequence: Synthetic polynucleotide

SEQ ID NO: 734 - protein, 704 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGAPLGLRLRGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 735 - DNA, 2088 bp, Artificial Sequence; identical to SEQ ID NO: 703
  Description of Artificial Sequence: Synthetic polynucleotide

SEQ ID NO: 736 - protein, 1280 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGAPLGLRLRGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 737 - DNA, 3816 bp, Artificial Sequence; identical to SEQ ID NO: 705
  Description of Artificial Sequence: Synthetic polynucleotide

SEQ ID NO: 738 - protein, 432 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGAPLGLRLRGKLTRAET

SEQ ID NO: 739 - DNA, 1253 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggtggt

SEQ ID NO: 740 - protein, 424 aa, Artificial Sequence
  Description of Artificial Sequence: Synthetic polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGAPLGLRLR

SEQ ID NO: 741 - DNA, 1250 bp, Artificial Sequence
  Description of Artificial Sequence: Synthetic polynucleotide
tataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcactggggt

SEQ ID NO: 742 - protein, 740 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGKLTRAETVFPDVDYVNSTEAETILDNITQSTQSFNDFTRVVGGEGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 743 - DNA, 2088 bp, Artificial Sequence; identical to SEQ ID NO: 703
  Description of Artificial Sequence: Synthetic polynucleotide

SEQ ID NO: 744 - protein, 1316 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGKLTRAETVFPDVDYVNSTEAETILDNITQSTQSFNDFTRVVGGEGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 745 - DNA, 3816 bp, Artificial Sequence; identical to SEQ ID NO: 705
  Description of Artificial Sequence: Synthetic polynucleotide

SEQ ID NO: 746 - protein, 459 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGSKLTRAETVFPDVDYVNSTEAETILDNITQSTQSFNDFTRVVGGEGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 747 - protein, 748 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGSKLTRAETVFPDVDYVNSTEAETILDNITQSTQSFNDFTRVVGGEGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 748 - protein, 1324 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGSKLTRAETVFPDVDYVNSTEAETILDNITQSTQSFNDFTRVVGGEGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 749 - protein, 422 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGKLTRAETVGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 750 - protein, 711 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGKLTRAETVGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 751 - protein, 1287 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGKLTRAETVGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 752 - protein, 422 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGDFTRVVGGGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 753 - protein, 711 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGDFTRVVGGGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 754 - protein, 1287 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQIVGGKVCPKGECPWQVLLLVNGAQLCGGGRTLINTIWVVSAAHCFDKIKNWRNLIAVLGEHDLSEHDGDEQSRRVAQVIIPSTYVPGTTNGDFTRVVGGGSKPQGRHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 755 - protein, 406 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 756 - protein, 694 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 757 - protein, 1290 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 758 - protein, 437 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRKLTRAETVFPDVDYVNSTEAETILDNITQSTQSFNDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 759 - protein, 738 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRKLTRAETVFPDVDYVNSTEAETILDNITQSTQSFNDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 760 - protein, 1321 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRKLTRAETVFPDVDYVNSTEAETILDNITQSTQSFNDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 761 - protein, 437 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGRVSVSQTSKLTRAETVFPDVDYVNSTEAETILDNITQSTQSFNDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 762 - protein, 738 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGRVSVSQTSKLTRAETVFPDVDYVNSTEAETILDNITQSTQSFNDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 763 - protein, 1321 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGRVSVSQTSKLTRAETVFPDVDYVNSTEAETILDNITQSTQSFNDFTRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 764 - protein, 406 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 765 - protein, 694 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 766 - protein, 1290 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 767 - protein, 437 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGKIPILEKRKLTRAETVFPDVDYVNSTEAETILDNITQSTQSFNDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 768 - protein, 738 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGKIPILEKRKLTRAETVFPDVDYVNSTEAETILDNITQSTQSFNDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 769 - protein, 1321 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGKIPILEKRKLTRAETVFPDVDYVNSTEAETILDNITQSTQSFNDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 770 - protein, 437 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGRVSVSQTSKLTRAETVFPDVDYVNSTEAETILDNITQSTQSFNDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 771 - protein, 738 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGRVSVSQTSKLTRAETVFPDVDYVNSTEAETILDNITQSTQSFNDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 772 - protein, 1321 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVPFPCGRVSVSQTSKLTRAETVFPDVDYVNSTEAETILDNITQSTQSFNDFTRVVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 773 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 774 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXAGSPTSTEE

SEQ ID NO: 775 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 776 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 777 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 778 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXTPSGATGSP

SEQ ID NO: 779 - protein, 61 aa, Homo sapiens
CEPAVPFPCGRVSVSQTSKLTRAETVFPDVDYVNSTEAETILDNITQSTQSFNDFTRVVGG

SEQ ID NO: 780 - protein, 30 aa, Homo sapiens
CTPTVEYPCGKIPILEKRNASKPQGRIVGG

SEQ ID NO: 781 - protein, 30 aa, Artificial Sequence
  Description of Artificial Sequence: Synthetic polypeptide
CTPTVEYPCGKIPILEKRNASKDFTRIVGG

SEQ ID NO: 782 - protein, 61 aa, Artificial Sequence
  Description of Artificial Sequence: Synthetic polypeptide
CTPTVEYPCGKIPILEKRKLTRAETVFPDVDYVNSTEAETILDNITQSTQSFNDFTRIVGG

SEQ ID NO: 783 - protein, 61 aa, Artificial Sequence
  Description of Artificial Sequence: Synthetic polypeptide
CTPTVPFPCGRVSVSQTSKLTRAETVFPDVDYVNSTEAETILDNITQSTQSFNDFTRIVGG

SEQ ID NO: 784 - protein, 30 aa, Artificial Sequence
  Description of Artificial Sequence: Synthetic polypeptide
CTPTVEYPCGKIPILEKRNASKDFTRVVGG

SEQ ID NO: 785 - protein, 61 aa, Artificial Sequence
  Description of Artificial Sequence: Synthetic polypeptide
CTPTVEYPCGKIPILEKRKLTRAETVFPDVDYVNSTEAETILDNITQSTQSFNDFTRVVGG

SEQ ID NO: 786 - protein, 61 aa, Artificial Sequence
  Description of Artificial Sequence: Synthetic polypeptide
CTPTVPFPCGRVSVSQTSKLTRAETVFPDVDYVNSTEAETILDNITQSTQSFNDFTRVVGG

What is claimed is:

1. A recombinant factor VII fusion protein comprising a factor VII polypeptide fused to an extended recombinant polypeptide (XTEN), wherein the XTEN comprises at least 36 amino acid residues, which comprises an amino acid sequence that has at least 90% sequence identity to SEQ ID NO: 36, and wherein the XTEN is characterized in that
   (a) the sum of glycine (G), aspartate (D), alanine (A), serine (S), threonine (T), glutamate (E) and proline (P) residues constitutes at least 80% of the total amino acids of the XTEN; and
   (b) the XTEN is non-repetitive such that
      (i) the XTEN contains no three contiguous amino acids that are identical unless the amino acids are serine; or
      (ii) at least 80% of the XTEN comprises one or more sequence motifs, each of the sequence motifs comprises from 9 to 14 amino acid residues, wherein any two contiguous amino acid residues do not occur more than twice in each of the sequence motifs.

2. The recombinant factor VII fusion protein of claim 1, wherein the sum of glycine (G), aspartate (D), alanine (A), serine (S), threonine (T), glutamate (E) and proline (P) residues constitutes at least 90% of the total amino acids of the XTEN.

3. The recombinant factor VII fusion protein of claim 1, wherein the XTEN is characterized in that the sum of asparagine and glutamine residues constitutes less than 10% of the total amino acids of the XTEN.

4. The recombinant factor VII fusion protein of claim 1, wherein the XTEN is further characterized in that the sum of methionine and tryptophan residues constitutes less than 2% of the total amino acids of the XTEN.

5. The recombinant factor VII fusion protein of claim 1, wherein the XTEN comprises at least 48 amino acid residues, at least 60 amino acid residues, at least 72 amino acid residues, at least 84 amino acid residues, or at least 96 amino acid residues.

6. The recombinant factor VII fusion protein of claim 1, wherein the XTEN comprises 144 amino acid residues or 288 amino acid residues.

7. A recombinant factor VII fusion protein comprising a factor VII polypeptide fused to an XTEN, wherein the XTEN comprises two or more sequence motifs, wherein at least one of the two or more sequence motifs is SEQ ID NO: 36.

8. The recombinant factor VII fusion protein of claim 7, wherein the XTEN is characterized in that
   (a) the sum of glycine (G), aspartate (D), alanine (A), serine (S), threonine (T), glutamate (E) and proline (P) residues constitutes at least 80% of the total amino acids of the XTEN; and
   (b) the XTEN is non-repetitive such that
      (i) the XTEN contains no three contiguous amino acids that are identical unless the amino acids are serine; or (ii) at least 80% of the XTEN comprises the sequence motifs, each of the sequence motifs comprises from 9 to 14 amino acid residues, wherein any two contiguous amino acid residues do not occur more than twice in each of the sequence motifs.

9. The recombinant factor VII fusion protein of claim 8, wherein the sum of glycine (G), aspartate (D), alanine (A), serine (S), threonine (T), glutamate (E) and proline (P) residues constitutes at least 90% of the total amino acids of the XTEN.

10. The recombinant factor VII fusion protein of claim 8, wherein the sequence motifs are selected from one or more of the sequence motifs having SEQ ID NOS: 31-34, one or more of the sequence motifs having SEQ ID NOS: 35-38, one or more of the sequence motifs having SEQ ID NOS: 39-46, one or more of the sequence motifs having SEQ ID NOS: 47-52, one or more of the sequence motifs having SEQ ID NOS: 53-56, or one or more of the sequence motifs having SEQ ID NOS: 57-60.

11. A recombinant factor VII fusion protein comprising a factor VII polypeptide fused to an XTEN, wherein the XTEN comprises an amino acid sequence that has at least 90% sequence identity to SEQ ID NO: 275, and wherein the XTEN is characterized in that
    (a) the sum of glycine (G), aspartate (D), alanine (A), serine (S), threonine (T), glutamate (E) and proline (P) residues constitutes at least 80% of the total amino acids of the XTEN; and
    (b) the XTEN is non-repetitive such that
        (i) the XTEN contains no three contiguous amino acids that are identical unless the amino acids are serine; or
        (ii) at least 80% of the XTEN comprises one or more sequence motifs, each of the sequence motifs comprises from 9 to 14 amino acid residues, wherein any two contiguous amino acid residues do not occur more than twice in each of the sequence motifs.

12. The recombinant factor VII fusion protein of claim 11, wherein the sum of glycine (G), aspartate (D), alanine (A), serine (S), threonine (T), glutamate (E) and proline (P) residues constitutes at least 90% of the total amino acids of the XTEN.

13. The recombinant factor VII fusion protein of claim 11, wherein the XTEN is further characterized in that the sum of asparagine and glutamine residues constitutes less than 10% of the total amino acids of the XTEN.

14. The recombinant factor VII fusion protein of claim 11, wherein the XTEN is further characterized in that the sum of methionine and tryptophan residues constitutes less than 2% of the total amino acids of the XTEN.

15. The recombinant factor VII fusion protein of claim 11, wherein the XTEN comprises an amino acid sequence that has at least 95% sequence identity to SEQ ID NO: 275.

16. The recombinant factor VII fusion protein of claim 15, wherein the XTEN comprises the amino acid sequence of SEQ ID NO: 275.

17. The recombinant factor VII fusion protein of claim 1, wherein the XTEN comprises an amino acid sequence that has at least 90% sequence identity to SEQ ID NOs: 233, 235, 237, 247, 251, 253, 259, 263, 271, 275, 277, 279, 281, 285, 287, 289, 291, 293, 295, or 297.

18. The recombinant factor VII fusion protein of claim 17, wherein the XTEN comprises an amino acid sequence that has is at least 95% sequence identity to SEQ ID NOs: 233, 235, 237, 247, 251, 253, 259, 263, 271, 275, 277, 279, 281, 285, 287, 289, 291, 293, 295, or 297.

19. The recombinant factor VII fusion protein of claim 18, wherein the XTEN comprises SEQ ID NOs: 233, 235, 237, 247, 251, 253, 259, 263, 271, 275, 277, 279, 281, 285, 287, 289, 291, 293, 295, or 297.

20. The recombinant factor VII fusion protein of claim 1, wherein the XTEN comprises an amino acid sequence that has at least 90% sequence identity to SEQ ID NOs: 63, 65, 69, 71, 73, 76, 77, 78, 79, 492, 496, 498, 500, 502, 504, 506, 514, 518, 526, 528, 532, 534, 538, 542, 544, 546, 548, 550, or 556.

21. The recombinant factor VII fusion protein of claim 20, wherein the XTEN comprises an amino acid sequence that has is at least 95% sequence identity to SEQ ID NOs: 63, 65, 69, 71, 73, 76, 77, 78, 79, 492, 496, 498, 500, 502, 504, 506, 514, 518, 526, 528, 532, 534, 538, 542, 544, 546, 548, 550, or 556.

22. The recombinant factor VII fusion protein of claim 21, wherein the XTEN comprises SEQ ID NOs: 63, 65, 69, 71, 73, 76, 77, 78, 79, 492, 496, 498, 500, 502, 504, 506, 514, 518, 526, 528, 532, 534, 538, 542, 544, 546, 548, 550, or 556.

23. The recombinant factor VII fusion protein of claim 1, wherein the XTEN comprises SEQ ID NO: 63 or SEQ ID NO: 65.

24. The recombinant factor VII fusion protein of claim 1, which comprises SEQ ID NOs: 596, 598, 600, 674, 676, 682, 684, 702, 704, 710, 712, 718, 720, 726, 728, 734, 736, 742, or 744.

25. The recombinant factor VII fusion protein of claim 24, which comprises SEQ ID NO: 600.

26. The recombinant factor VII fusion protein of claim 16, wherein a terminal half-life of the recombinant factor VII fusion protein administered to a subject is longer than the terminal half-life of a protein consisting of the factor VII polypeptide when administered to a subject.

27. The recombinant factor VII fusion protein of claim 1, wherein the XTEN is fused to the C-terminus of the factor VII polypeptide.

28. The recombinant factor VII fusion protein of claim 1, further comprising a cleavage sequence fused to the FVII polypeptide, the XTEN, or both.

29. The recombinant factor VII fusion protein of claim 28, wherein the cleavage sequence is cleavable by a mammalian protease selected from factor XIa, factor XIIa, kallikrein, factor VIIa, factor IXa, factor IIa (thrombin), Elastase-2, MMP-12, MMP12, MMP-17, MMP-20, or any combination thereof.

30. The recombinant factor VII fusion protein of claim 28, wherein the cleavage sequence, when cleaved by a mammalian protease, releases the XTEN from the factor VII polypeptide.

31. The recombinant factor VII fusion protein of claim 1, wherein the XTEN is incorporated between any two adjacent domains contained in the factor VII polypeptide.

32. The recombinant factor VII fusion protein of claim 31, wherein the two adjacent domains are selected from Gla and EGF1, EFG1 and EGF2, EFG2 and activation peptide (AP), or activation peptide and peptidase S1 (Pro).

33. The recombinant factor VII fusion protein of claim 1, comprising Formula VII:

(Gla)-(XTEN)u-(EGF1)-(XTEN)v-(EGF2)-(AP1)-(XTEN)w-(AP2)-(XTEN)x-(Pro)-(S)y-(XTEN)z wherein independently for each occurrence,
(a) Gla is a Gla domain of factor VII;
(b) EGF1 is an EGF1 domain of factor VII;
(c) EGF2 is an EFG2 domain of factor VII;
(d) AP 1 is a portion of an activator peptide domain of factor VII;

(e) AP2 is a portion of an activator peptide domain of factor IX that includes at least a first cleavage sequence;
(f) PRO is a protease domain of factor VII;
(g) S is a spacer sequence having between 1 to about 50 amino acid residues and comprising an optional cleavage sequence;
(h) u is either 0 or 1;
(i) v is either 0 or 1;
(j) x is either 0 or 1;
(k) y is either 0 or 1; and
(l) z is either 0 or 1, with the proviso that $u+v+x+y+z \geq 1$.

34. The recombinant factor VII fusion protein of claim 32, wherein the XTEN is incorporated between EGF2 and activation peptide (AP).

35. A pharmaceutical composition comprising the recombinant factor VII fusion protein of claim 1 and a pharmaceutically acceptable carrier.

36. A pharmaceutical composition comprising the recombinant factor VII fusion protein of claim 11 and a pharmaceutically acceptable carrier.

37. A method of controlling or ameliorating a bleeding episode in a subject in need thereof, comprising administering to said subject a composition comprising a therapeutically effective amount of the recombinant factor VII fusion protein of claim 1.

38. A method of controlling or ameliorating a bleeding episode in a subject in need thereof, comprising administering to said subject a composition comprising a therapeutically effective amount of the recombinant factor VII fusion protein of claim 11.

39. The method of claim 37 or 38, wherein said bleeding episode is the result of hemophilia A or hemophilia B.

40. The method of claim 39, wherein the therapeutically effective amount of recombinant factor VII fusion protein is sufficient to bypass the need to exogenously administer factor VIII and/or factor IX to the subject with hemophilia A or hemophilia B.

41. A method of treating a subject deficient in a clotting protein, comprising administering to said subject a composition comprising a therapeutically effective amount of the recombinant factor VII fusion protein of claim 1, wherein the clotting protein is factor VII, factor IX, or factor XI.

42. A method of treating a subject deficient in a clotting protein, comprising administering to said subject a composition comprising a therapeutically effective amount of the recombinant factor VII fusion protein of claim 11, wherein the clotting protein is factor VII, factor IX, or factor XI.

* * * * *